United States Patent
Drummond Samuelson et al.

(10) Patent No.: US 11,470,828 B2
(45) Date of Patent: Oct. 18, 2022

(54) RODENT MODEL OF MOOD DISORDERS

(71) Applicant: REGENERON PHARMACEUTICALS, INC., Tarrytown, NY (US)

(72) Inventors: Meghan Drummond Samuelson, Katonah, NY (US); Brian Zambrowicz, Sleepy Hollow, NY (US); Ka-Man Venus Lai, San Francisco, CA (US); Charleen Hunt, Dumont, NJ (US); Susannah Brydges, Putnam Valley, NY (US); Andrew J. Murphy, Croton-on-Hudson, NY (US); Claudia Gonzaga-Jauregui, Elmsford, NY (US); Jose Rojas, Newburgh, NY (US); Nicole Alessandri-Haber, Rye Brook, NY (US); Robert Breese, Patterson, NY (US); Susan D. Croll, Putnam Valley, NY (US)

(73) Assignee: Regeneran Pharmaceuticals, Inc., Tarrytown, NY (US)

( * ) Notice: Subject to any disclaimer, the term of this patent is extended or adjusted under 35 U.S.C. 154(b) by 70 days.

(21) Appl. No.: 16/744,493

(22) Filed: Jan. 16, 2020

(65) Prior Publication Data
US 2020/0229409 A1  Jul. 23, 2020

Related U.S. Application Data

(60) Provisional application No. 62/793,523, filed on Jan. 17, 2019, provisional application No. 62/899,849, filed on Sep. 13, 2019.

(51) Int. Cl.
*A01K 67/027* (2006.01)
*C12N 15/85* (2006.01)
*C07K 14/72* (2006.01)

(52) U.S. Cl.
CPC ........ *A01K 67/0278* (2013.01); *C07K 14/723* (2013.01); *C12N 15/8509* (2013.01); *A01K 2207/15* (2013.01); *A01K 2217/072* (2013.01); *A01K 2227/105* (2013.01); *A01K 2267/0356* (2013.01)

(58) Field of Classification Search
CPC .............. C07K 14/723; C12N 15/8509; A01K 67/0278; A01K 2207/15; A01K 2217/072; A01K 2267/0356; A01K 2217/075
USPC ............ 800/13, 18; 435/320.1, 325
See application file for complete search history.

(56) References Cited

U.S. PATENT DOCUMENTS

| | | | |
|---|---|---|---|
| 10,266,582 B2 | 4/2019 | Gonzaga-Jauregui | |
| 10,562,953 B2 | 2/2020 | Gonzaga-Jauregui | |
| 2018/0030114 A1* | 2/2018 | Gonzaga-Jauregui | ..................... C12Q 1/6883 |

FOREIGN PATENT DOCUMENTS

| | | |
|---|---|---|
| CN | 103906842 A | 7/2014 |
| CN | 2017/151453 A1 | 9/2017 |
| CN | 109068621 A | 12/2018 |
| WO | 01/04137 A1 | 1/2001 |
| WO | 2004/040000 A2 | 5/2004 |
| WO | 2008/061209 A2 | 5/2008 |
| WO | 2013/064443 A1 | 5/2013 |
| WO | 2018/022967 A1 | 2/2018 |

OTHER PUBLICATIONS

Sheer et al. (2013) Drug Discovery Today, vol. 18 (23/24), 1200-1211.*
Devoy et al. (2012) Nature, vol. 13, 14-20.*
Calver et al. (2003) Mol. Brain. Res., vol. 110, 305-317.*
Voigt et al. (2012) Chem. Senses, vol. 37, 897-911.*
Matsuda et al. (2004) Methods in Molecular Biology, vol. 259, Receptor Signal Transduction protocols, 2nd ed., Edited by :G.B. Willars and R.A.J. Challiss, 379-390.*
Bochdanovits Z. et al., "Genome-Wide Prediction of Functional Gene-Gene Interactions Inferred from Patterns of Genetic Differentiation in Mice and Men", PLOS One 3(2)e1593 (Feb. 2008).
Calver A.R. et al., "Molecular Cloning and Characterisation of a Novel GABAB-Related G-Protein Coupled Receptor", Molecular Brain Research 110:305-317 (2003).
Catapano L.A. et al., "G Protein-Coupled Receptors in Major Psychiatric Disorders", Biochimica et Biophysica Acta 1768(4):976-993 (2007).
Cherezov V. et al., "High-Resolution Crystal Structure of an Engineered Human B2-Adrenergic G Protein-Coupled Receptor", Science 318:1258-1265 (Nov. 23, 2007).
Clark R.B., "Profile of Brian K. Kobilka and Robert J. Lefkowitz, 2012 Nobel Laureates in Chemistry", PNAS 110(14): 5274-5275 (Apr. 2, 2013).
Corum C.R. et al., "Effects of Acute Exposure to Stress on Subsequent Aggression and Locomotion Performance", Psychosomatic Medicine 39(6):436-443 (Nov.-Dec. 1977).

(Continued)

*Primary Examiner* — Anne Marie S Wehbe
(74) *Attorney, Agent, or Firm* — Scully, Scott, Murphy & Presser, P.C.; Brian A. Cocca

(57) ABSTRACT

This disclosure relates to an animal model of human disease. More specifically, this disclosure relates to a rodent model of mood disorders such as unipolar depression and an anxiety disorder. Disclosed herein are genetically modified rodent animals that carry a humanized G protein-coupled receptor 156 (GPR156) gene that encodes a mutant human GPR156 protein comprising Asp at an amino acid position corresponding to position 533 in a full length wild type human GPR156 protein.

24 Claims, 7 Drawing Sheets

Specification includes a Sequence Listing.

(56) References Cited

OTHER PUBLICATIONS

Devoy A. et al., "Genomically Humanized Mice: Technologies and Promises", Nature Reviews Genetics 13:14-20 (Jan. 2012).
Fernandez S.P. et al., "Investigating Anxiety and Depressive-Like Phenotypes in Genetic Mouse Models of Serotonin Depletion", Neuropharmacology 62(1):144-154 (Aug. 29, 2012).
Gold P.W. et al., "Clinical and Biochemical Manifestations of Depression-Relation to the Neurobiology of Stress", The New England Journal of Medicine 319(6):348-353 (Aug. 11, 1988).
Kobilka B.K., "G Protein Coupled Receptor Structure and Activation", Biochimica et Biophysica Acta 1768:794-807 (2007).
Li B. et al., "Synaptic Potentiation onto Habenula Neurons in the Learned Helplessness Model of Depression", Nature 470:535-539 (Feb. 24, 2011).
Lloyd C., "Life Events and Depressive Disorder Reviewed", Arch Gen Psychiatry 37:541-548 (May 1980).
Lund P.K. et al., "Nucleotide Sequence Analysis of a cDNA Encoding Human Ubiquitin Reveals That Ubiquitin is Synthesized as a Precursor", The Journal of Biological Chemistry 260(12):7609-7613 (Jun. 25, 1985).
Mirrione M.M. et al., "Increased Metabolic Activity in the Septum and Habenula During Stress is Linked to Subsequent Expression of Learned Helplessness Behavior", Frontiers in Human Neuroscience 8(29):1-8 (Feb. 2014).
Morris J.S. et al., "Covariation of Activity in Habenula and Dorsal Raphe Nuclei Following Tryptophan Depletion", NeuroImage 10:163-172 (1999).
Njung'e K. et al., "Effects of 5-HT Uptake Inhibitors, Agonists and Antagonists on the Burying of Harmless Objects by Mice; a Putative Test for Anxiolytic Agents", Br. J. Pharmacol. 104:105-112 (1991).
Porsolt R.D. et al., "Behavioural Despair in Mice: A Primary Screening Test for Antidepressants", Arch. Int. Pharmacodyn 229:327-336 (1977).
Poueymirou W.T. et al., "F0 Generation Mice Fully Derived from Gene-Targeted Embryonic Stem Cells Allowing Immediate Phenotypic Analyses", Nature Biotechnology 25(1):91-99 (Jan. 2007).
Sartorius A. et al., "Remission of Major Depression Under Deep Brain Stimulation of the Lateral Habenula in a Therapy-Refractory Patient", Biol Psychiatry 67:e9-e11 (2010).
Shepard P.D. et al., "The Presence of Absence: Habenular Regulation of Dopamine Neurons and the Encoding of Negative Outcomes", Schizophrenia Bulletin 32(3):417-421 (2006).
Shumake J. et al., "Opposite Metabolic Changes in the Habenula and Ventral Tegmental Area of a Genetic Model of Helpless Behavior", Brain Research 963:274-281 (2003).
Thomas A. et al., "Marble Burying Reflects a Repetitive and Perseverative Behavior More Than Novelty-Induced Anxiety", Psychopharmacology 204:361-373 (2009).
Ullsperger M. et al., "Error Monitoring Using External Feedback: Specific Roles of the Habenular Complex, the Reward System, and the Cingulate Motor Area Revealed by Functional Magnetic Resonance Imaging", The Journal of Neuroscience 23(10):4308-4314 (May 15, 2003).
Valenzuela D.M. et al., "High-Throughput Engineering of the Mouse Genome Coupled With High-Resolution Expression Analysis", Nature Biotechnology 21(6):652-659 (Jun. 2003).
Vassilatis D.K. et al., "The G Protein-Coupled Receptor Repertoires of Human and Mouse", PNAS 100 (8):4903-4908 (Apr. 15, 2003).
Weiss J.M. et al., "A Model for Neurochemical Study of Depression", Behavioral Models and the Analysis of Drug Action 195-223 (Mar. 28-31, 1982).
Wirtshafter D. et al., "Dopamine Agonists and Stress Produce Different Patterns of Fos-Like Immunoreactivity in the Lateral Habenula", Brain Research 633:21-26 (1994).
NCBI Reference Sequence No. NC_000082.6 (2 pages) (Aug. 8, 2019).
NCBI Reference Sequence No. NC_000003.12 (2 pages) (Mar. 2, 2020).
NCBI Reference Sequence No. NC_005110.4 (2 pages) (Jul. 27, 2016).
Database, UniProt, "SubName: Full=G protein-coupled receptor 156 {ECO: 0000313, Ensembl: ENSCPOP00000019815}", 2012, XP002774351.
Database, Geneseq, "UDP glycosyltransferase 1 (UGT1A1) Allele-specific Oligonucleotide #59", 2002, XP002774352.
Database, EMBL, "JP 2015518712-A/41866: Compositions and Methods for Modulating MECP2 Expression", 2015, XP002774353.
Database, Geneseq, "Human TNFRSF11B gene ASO probe, SEQ ID No. 11", 2001, XP002774354.
Slides presented by Claudia Gonzaga-Jauregui and Nicole Alessandri-Haber at a Columbia University-Clinic for Special Children (CSC)—Regeneron Genetics Center (RGC) Joint Team Meeting on Feb. 27, 2018.
International Search Report and Written Opinion dated Apr. 21, 2020 received in International Application No. PCT/US2020/013801.
International Search Report and Written Opinion dated Oct. 17, 2017 received in International Application No. PCT/US2017/044321.

* cited by examiner

RODENT MODEL OF MOOD DISORDERS

CROSS REFERENCE TO RELATED APPLICATIONS

This application claims the benefits of priority from U.S. Provisional Applications 62/793,523 filed Jan. 17, 2019 and 62/899,849 filed Sep. 13, 2019, the contents of both of which are incorporated herein by reference.

FIELD OF THE DISCLOSURE

This disclosure relates to an animal model of human disease. More specifically, this disclosure relates to a rodent model of mood disorders such as unipolar depression and an anxiety disorder. Disclosed herein are genetically modified rodent animals that carry a humanized G protein-coupled receptor 156 (GRP 156) gene that encodes a mutant human GPR156 protein comprising Asp at an amino acid position corresponding to position 533 in a full length wild type human GPR156 protein.

INCORPORATION BY REFERENCE OF SEQUENCE LISTING

The sequence listing in the ASCII text file, named as 36506PCT_10269WO01_SequenceListing.txt of 1299 KB, created on Jan. 8, 2020, and submitted to the United States Patent and Trademark Office via EFS-Web, is incorporated herein by reference.

BACKGROUND ART

Various references, including patents, patent applications, accession numbers, technical articles, and scholarly articles are cited throughout the specification. Each reference is incorporated by reference herein, in its entirety and for all purposes.

G protein-coupled receptors (GPCRs) are a large superfamily of cell surface receptors that are characterized by 7 helical transmembrane domains, together with N-terminal extracellular and C-terminal intracellular domains (Cherezov V, et al., Science 318: 1258-1265 (2007)). GPCRs are expressed in a variety of cell types, and participate in transducing extracellular signals across the cellular membrane and into the cellular interior (Kobilka R, Biochim. Biophys. Acta 1768: 794-807 (2007)). In 2012, the Nobel Prize in Chemistry was awarded to two scientists who identified how GPCRs function (Clark R, Proc. Natl. Acad. Sci. USA 110: 5274-5275 (2013)).

GPR156 (G protein-coupled receptor 156) is a human gene which encodes a GPCR belonging to metabotropic glutamate receptor subfamily (Calver A, et al., Brain Res. Mol. Brain Res. 110: 305-307 (2003)). Other names that have been used to reference GPR156 in the literature are GABABL (GABAB-like or GABA$_{BL}$) and PGR28 (Vassilatis D, Proc. Natl. Acad. Sci. USA 100: 4903-4908 (2003)). In mice, GPR156 is referred to as Gpr156 or Gababl.

SUMMARY OF DISCLOSURE

Disclosed herein are genetically modified rodents suitable for use as an animal model of mood disorders such as unipolar depression and anxiety disorders. More specifically, disclosed herein are genetically modified rodent animals (e.g., mouse or rat) that carry a humanized Gpr156 gene at an endogenous rodent Gpr156 locus, wherein the humanized Gpr156 gene encodes a wild type human GPR156 protein or a mutant human GPR156 protein comprising Asp at an amino acid position corresponding to position 533 in a full length wild type human GPR156 protein (also referred to herein as an "E533D variation"). Also disclosed herein are methods and targeting vectors for making a genetically modified rodent, methods of breeding, and use of a genetically modified rodent as an animal model of mood disorders for screening and testing therapeutic agents.

In one aspect, disclosed herein is a genetically modified rodent whose genome comprises a humanized Gpr156 gene at an endogenous rodent Gpr156 locus, wherein the humanized Gpr156 gene comprises a rodent Gpr156 nucleic acid portion and a human GPR156 nucleic acid portion, and wherein expression of the humanized Gpr156 gene is under control of the rodent Gpr156 promoter at the endogenous rodent Gpr156 locus. The rodent Gpr156 nucleic acid portion and the human GPR156 nucleic acid portion each can be a genomic DNA or a cDNA.

In some embodiments, a humanized Gpr156 gene in a rodent encodes a mutant human GPR156 protein comprising an E533D variation.

In some embodiments, the human GPR156 nucleic acid portion in a humanized Gpr156 gene comprises a coding sequence of a human GPR156 gene, wherein the coding sequence comprises the ATG start codon in the first coding exon through the stop codon in the last coding exon of the human GPR156 gene, and wherein the human GPR156 gene comprises nucleotides that encode an E533D variation. In some embodiments, the human GPR156 nucleic acid portion in a humanized Gpr156 gene further comprises a 5' non-coding exonic sequence or a 3' non-coding exonic sequence of a human GPR156 gene, or a combination thereof. A 5' non-coding exonic sequence of a human GPR156 gene can include, for example, any 5' non-coding exon, and/or the 5' non-coding portion of the first coding exon of a human GPR156 gene. A 3' non-coding exonic sequence of a human GPR156 gene can include, for example, the 3' UTR of a human GPR156 gene. In specific embodiments, the human GPR156 nucleic acid portion in a humanized Gpr156 gene comprises the ATG start codon in the first coding exon through the last exon (i.e., including the 3' UTR) of a human GPR156 gene, with the human GPR156 gene comprising nucleotides that encode an E533D variation.

In some embodiments, the rodent Gpr156 nucleic acid portion in a humanized Gpr156 gene comprises a 5' non-coding exonic sequence or a 3' non-coding exonic sequence of a rodent Gpr156 gene, or a combination thereof. In embodiments where a rodent Gpr156 gene is a mouse Gpr156 gene, a 5' non-coding exonic sequence can include, for example, exon 1, the 5' non-coding portion of exon 2 (the first coding exon), or a combination thereof, of the mouse Gpr156 gene; and a 3' non-coding exonic sequence can include, for example, the 3' UTR of exon 10 (the 9th and last coding exon) of the mouse Gpr156 gene. In embodiments where a rodent Gpr156 gene is a rat Gpr156 gene, a 5' non-coding exonic sequence can include, for example, the 5' non-coding portion of exon 1 (also being the first coding exon) of the rat Gpr156 gene; and a 3' non-coding exonic sequence can include, for example, the 3' UTR of exon 9 (also being the last coding exon) of the rat Gpr156 gene.

In specific embodiments, a humanized Gpr156 gene comprises a '5 non-coding exonic sequence of a rodent Gpr156 gene, and the ATG start codon in the first coding exon through the last exon of a human GPR156 gene, with the human GPR156 gene comprising nucleotides that encode an E533D variation; and in certain embodiments, such humanized Gpr156 gene further comprises a 3' non-coding exonic sequence of a rodent Gpr156 gene, placed downstream of the last exon of the human GPR156 gene.

In some embodiments, the rodent Gpr156 gene that provides the rodent Gpr156 nucleic acid portion in a humanized Gpr156 gene is the endogenous rodent Gpr156 gene.

In some embodiments, a humanized Gpr156 gene in a rodent is formed from a replacement of a rodent genomic fragment of an endogenous rodent Gpr156 gene at an endogenous rodent Gpr156 locus with a human GPR156 nucleic acid encoding a mutant human GPR156 protein comprising an E533D variation. The human GPR156 nucleic acid can be a genomic DNA or a cDNA.

In some embodiments, the human GPR156 nucleic acid encoding the mutant human GPR156 protein comprises a coding sequence (e.g., a genomic or cDNA sequence) comprising the ATG start codon in the first coding exon through the stop codon in the last coding exon of a human GPR156 gene, wherein the human GPR156 gene comprises nucleotides that encode an E533D variation. In some embodiments, the human GPR156 nucleic acid portion in a humanized Gpr156 gene further comprises a 5' non-coding exonic sequence or a 3' non-coding exonic sequence of a human GPR156 gene, or a combination thereof. In some embodiments, the human GPR156 nucleic acid comprises the 5' non-coding sequence of the first coding exon or the 3' UTR of a human GPR156 gene, or a combination thereof. In specific embodiments, the human GPR156 nucleic acid comprises the ATG start codon in the first coding exon through the last exon (i.e., through the 3' UTR) of a human GPR156 gene, with the human GPR156 gene comprising nucleotides that encode an E533D variation.

In some embodiments, the rodent genomic fragment being replaced comprises the ATG start codon (in the first coding exon) through the stop codon (in the last coding exon) of the endogenous rodent Gpr156 gene. In some embodiments, the rodent genomic fragment being replaced further comprises a 5' non-coding exonic sequence or a 3' non-coding exonic sequence of a rodent Gpr156 gene, or a combination thereof.

In some embodiments, a humanized Gpr156 gene encodes a mutant human GPR156 protein comprising an E533D variation, wherein the mutant protein is a full length GPR156 protein of 814 amino acids. In some embodiments, the mutant human GPR156 protein comprises the amino acid sequence set forth in SEQ ID NO: 5. In some embodiments, the mutant human GPR156 protein comprises the amino acid sequence set forth in SEQ ID NO: 6. In some embodiments, the mutant human GPR156 protein comprises an amino acid sequence that is substantially identical to SEQ ID NO: 5 or SEQ ID NO: 6.

In some embodiments, a humanized Gpr156 gene encodes a mutant human GPR156 protein that is a short isoform GPR156 protein of 810 amino acids and comprises an E533D variation. In some embodiments, the mutant human GPR156 protein comprises the amino acid sequence set forth in SEQ ID NO: 7. In some embodiments, the mutant human GPR156 protein comprises the amino acid sequence set forth in SEQ ID NO: 8. In some embodiments, the mutant human GPR156 protein comprises an amino acid sequence that is substantially identical to SEQ ID NO: 7 or SEQ ID NO: 8.

In further embodiments, a humanized Gpr156 gene in a rodent encodes a wild type human GPR156 protein.

In some embodiments, the human GPR156 nucleic acid portion in a humanized Gpr156 gene comprises a coding sequence (e.g., a genomic or cDNA sequence) of a human GPR156 gene, wherein the coding sequence comprises the ATG start codon in the first coding exon through the stop codon in the last coding exon of the human GPR156 gene. In some embodiments, the human GPR156 nucleic acid portion in a humanized Gpr156 gene further comprises a 5' non-coding exonic sequence or a 3' non-coding exonic sequence of a human GPR156 gene, or a combination thereof. In some embodiments, the human GPR156 nucleic acid portion in a humanized Gpr156 gene comprises the 5' non-coding sequence of the first coding exon or the 3' UTR of a human GPR156 gene, or a combination thereof. In specific embodiments, the human GPR156 nucleic acid portion in a humanized Gpr156 gene comprises the ATG start codon in the first coding exon through the last exon (i.e., through the 3' UTR) of a human GPR156 gene.

In some embodiments, the rodent Gpr156 nucleic acid portion in a humanized Gpr156 gene comprises a 5' non-coding exonic sequence or a 3' non-coding exonic sequence of a rodent Gpr156 gene, or a combination thereof. In embodiments where the rodent Gpr156 gene is a mouse Gpr156 gene, the rodent Gpr156 nucleic acid portion in a humanized Gpr156 may comprise exon 1, the 5' non-coding sequence in exon 2, or the 3' UTR of exon 10 of the mouse Gpr156 gene, or a combination thereof.

In specific embodiments, a humanized Gpr156 gene comprises a 5' non-coding exonic sequence of a rodent Gpr156 gene, and the ATG start codon in the first coding exon through the last exon of a human GPR156 gene; and in certain embodiments, such humanized Gpr156 gene further comprises a 3' non-coding exonic sequence of a rodent Gpr156 gene, placed downstream of the last exon of the human GPR156 gene. In embodiments where the rodent Gpr156 gene is a mouse Gpr156 gene, a humanized Gpr156 gene may comprise exon 1, the 5' non-coding sequence in exon 2, or the 3' UTR of exon 10, of the mouse Gpr156 gene, or a combination thereof, wherein the 3' UTR of exon 10 of the mouse Gpr156 gene, when present, is placed downstream of the last exon of the human GPR156 gene.

In some embodiments, the rodent Gpr156 gene that provides the rodent Gpr156 nucleic acid portion in a humanized Gpr156 gene is an endogenous rodent Gpr156 gene.

In some embodiments, a humanized Gpr156 gene is formed from a replacement of a rodent genomic fragment of an endogenous rodent Gpr156 gene at an endogenous rodent Gpr156 locus with a human GPR156 nucleic acid encoding a wild type human GPR156 protein. The human GPR156 nucleic acid can be a genomic DNA or a cDNA.

In some embodiments, the human GPR156 nucleic acid encoding a wild type human GPR156 protein comprises a coding sequence (e.g., a genomic or cDNA sequence) comprising the ATG start codon in the first coding exon through the stop codon in the last coding exon of a human GPR156 gene. In some embodiments, the human GPR156 nucleic acid further comprises a 5' and/or a 3' non-coding exonic sequence of a human GPR156 gene. In some embodiments, the human GPR156 nucleic acid comprises the 5' non-coding sequence in the first coding exon or the 3' UTR of a human GPR156 gene, or a combination thereof. In specific embodiments, the human GPR156 nucleic acid comprises the ATG start codon in the first coding exon through the last exon (i.e., through the 3' UTR) of a human GPR156 gene.

In some embodiments, the rodent genomic fragment being replaced comprises the ATG start codon in the first coding exon through the stop codon in the last coding exon of the endogenous rodent Gpr156 gene. In some embodiments, the rodent genornic fragment being replaced further comprises a 5' and/or a 3' non-coding exonic sequence of the endogenous rodent Gpr156 gene. In embodiments where the rodent is a mouse, the mouse genomic fragment being replaced may comprise exon 1, the 5' non-coding sequence in exon 2, or the 3' UTR of exon 10 of the endogenous mouse Gpr156 gene, or a combination thereof.

In some embodiments, a humanized Gpr156 gene encodes a wild type human GPR156 protein, wherein the wild type protein is a full length wild type human GPR156 protein of 814 amino acids. In some embodiments, the full length wild type human GPR156 protein comprises the amino acid sequence set forth in SEQ ID NO: 1. In some embodiments, the full length wild type human GPR156 protein comprises the amino acid sequence set forth in SEQ ID NO: 2. In some embodiments, the full length wild type human GPR156 protein comprises an amino acid sequence that is substantially identical to SEQ ID NO: 1 or SEQ ID NO: 2, and comprises Glu at position 533.

In some embodiments, a humanized Gpr156 gene encodes a wild type human GPR156 protein that is a short isoform wild type human GPR156 protein of 810 amino acids. In some embodiments, the wild type human GPR156 protein comprises the amino acid sequence set forth in SEQ ID NO: 3. In some embodiments, the wild type human GPR156 protein comprises the amino acid sequence set forth in SEQ ID NO: 4. In some embodiments, the wild type human GPR156 protein comprises an amino acid sequence of 810 amino acids that is substantially identical to SEQ ID NO: 3 or SEQ ID NO: 4 and that comprises Glu at position 529.

In some embodiments, a rodent disclosed herein is heterozygous for a humanized Gpr156 gene. In some embodiments, a rodent disclosed herein is homozygous for a humanized Gpr156 gene.

In some embodiments, a rodent disclosed herein is incapable of expressing an endogenous rodent Gpr156 protein.

In some embodiments, a rodent disclosed herein is a mouse or a rat.

In another aspect, disclosed herein is an isolated rodent cell or tissue, whose genome comprises a humanized Gpr156 gene at an endogenous rodent Gpr156 locus, wherein the humanized Gpr156 gene comprises a rodent Gpr156 nucleic acid portion and a human GPR156 nucleic acid portion, and wherein expression of the humanized Gpr156 gene is under control of the rodent Gpr156 promoter at the endogenous rodent Gpr156 locus. The rodent Gpr156 nucleic acid portion and the human GPR156 nucleic acid portion each can be a genomic DNA or a cDNA.

In some embodiments, a humanized Gpr156 gene in an isolated rodent cell or tissue encodes a mutant human GPR156 protein comprising an E533D variation.

In some embodiments, the human GPR156 nucleic acid portion in a humanized Gpr156 gene in an isolated rodent cell or tissue comprises a coding sequence of a human GPR156 gene, wherein the coding sequence comprises the ATG start codon in the first coding exon through the stop codon in the last coding exon of the human GPR156 gene, and wherein the human GPR156 gene comprises nucleotides (in the last coding exon) that encode an E533D variation. In some embodiments, the human GPR156 nucleic acid portion in a humanized Gpr156 gene further comprises a 5' and/or a 3' non-coding exonic sequence of a human GPR156 gene. In some embodiments, the human GPR156 nucleic acid portion in a humanized Gpr156 gene comprises the 5' non-coding sequence of the first coding exon or the 3' UTR of a human GPR156 gene, or a combination thereof. In specific embodiments, the human GPR156 nucleic acid portion in a humanized Gpr156 gene comprises the ATG start codon in the first coding exon through the last exon (i.e., through the 3' UTR of a human GPR156 gene, with the human GPR156 gene comprising nucleotides that encode an E533D variation.

In some embodiments, the rodent Gpr156 nucleic acid portion in a humanized Gpr156 gene in an isolated rodent cell or tissue comprises a 5' non-coding exonic sequence or a 3' non-coding exonic sequence of a rodent Gpr156 gene, or a combination thereof. In embodiments where the rodent Gpr156 gene is a mouse Gpr156 gene, the rodent Gpr156 nucleic acid portion in a humanized Gpr156 gene in an isolated rodent cell or tissue may comprise exon 1, the 5' non-coding sequence in exon 2, or the 3' UTR of exon 10 of the mouse Gpr156 gene, or a combination thereof.

In specific embodiments, a humanized Gpr156 gene in an isolated rodent cell or tissue comprises a 5' non-coding exonic sequence of a rodent Gpr156 gene, and the ATG start codon in the first coding exon through the last exon of a human GPR156 gene, with the human GPR156 gene comprising nucleotides that encode an E533D variation; and in certain embodiments, such humanized Gpr156 gene further comprises a 3' non-coding exonic sequence of a rodent Gpr156 gene, placed downstream of the last exon of the human GPR156 gene.

In some embodiments, the rodent Gpr156 gene that provides the rodent Gpr156 nucleic acid portion in a humanized Gpr156 gene in an isolated rodent cell or tissue is the endogenous rodent Gpr156 gene.

In some embodiments, a humanized Gpr156 gene in an isolated rodent cell or tissue is formed from a replacement of a rodent genomic fragment of an endogenous rodent Gpr156 gene at an endogenous rodent Gpr156 locus with a human GPR156 nucleic acid encoding a mutant human GPR156 protein comprising an E533D variation. The human GPR156 nucleic acid portion can be a genomic DNA or a cDNA.

In some embodiments, the human GPR156 nucleic acid encoding the mutant human GPR156 protein comprises a coding sequence (e.g., a genomic or cDNA sequence) comprising the ATG start codon in the first coding exon through the stop codon in the last coding exon of a human GPR156 gene, wherein the human GPR156 gene comprises nucleotides that encode an E533D variation. In some embodiments, the human GPR156 nucleic acid further comprises a 5' and/or a 3' non-coding exonic sequence of a human GPR156 gene. In some embodiments, the human GPR156 nucleic acid comprises the 5' non-coding portion of the first coding exon or the 3' UTR of a human GPR156 gene, or a combination thereof. In specific embodiments, the human GPR156 nucleic acid comprises the ATG start codon in the first coding exon through the last exon (i.e., including the 3' UTR) of a human GPR156 gene, with the human GPR156 gene comprising nucleotides that encode an E533D variation.

In some embodiments, the rodent genomic fragment being replaced comprises the ATG start codon in the first coding exon through the stop codon in the last coding exon of the endogenous rodent Gpr156 gene. In some embodiments, the rodent genomic fragment being replaced further comprises a 5' and/or a 3' non-coding exonic sequence of the endogenous rodent Gpr156 gene. In embodiments where the rodent cell or tissue is a mouse cell or tissue, the mouse genomic fragment being replaced may comprise exon 1, the 5' non-coding sequence in exon 2, or the 3' UTR of exon 10 of the endogenous mouse Gpr156 gene, or a combination thereof.

In some embodiments, a humanized Gpr156 gene in an isolated rodent cell or tissue encodes a mutant human GPR156 protein comprising an E533D variation, wherein the mutant protein is a full length GPR156 protein of 814 amino acids. In some embodiments, the mutant human GPR156 protein comprises the amino acid sequence set forth in SEQ ID NO: 5. In some embodiments, the mutant human GPR156 protein comprises the amino acid sequence set forth in SEQ ID NO: 6: In some embodiments, the mutant human GPR156 protein comprises an amino acid sequence that is substantially identical to SEQ ID NO: 5 or SEQ ID NO: 6.

In some embodiments, a humanized Gpr156 gene in an isolated rodent cell or tissue encodes a mutant human GPR156 protein that is a short isoform GPR156 protein of 810 amino acids and comprises an E533D variation. In some embodiments, the mutant human GPR156 protein comprises the amino acid sequence set forth in SEQ ID NO: 7. In some embodiments, the mutant human GPR156 protein comprises the amino acid sequence set forth in SEQ ID NO: 8. In some embodiments, the mutant human GPR156 protein comprises an amino acid sequence that is substantially identical to SEQ ID NO: 7 or SEQ ID NO: 8.

In further embodiments, a humanized Gpr156 gene in an isolated rodent cell or tissue encodes a wild type human GPR156 protein.

In some embodiments, the human GPR156 nucleic acid portion in a humanized Gpr156 gene in an isolated rodent cell or tissue comprises a coding sequence (e.g., a genomic or cDNA sequence) of a human GPR156 gene, wherein the coding sequence comprises the ATG start codon in the first coding exon through the stop codon in the last coding exon of the human GPR156 gene. In some embodiments, the human GPR156 nucleic acid portion in a humanized Gpr156 gene further comprises a 5' and/or a 3' non-coding exonic sequence of a human GPR156 gene. In some embodiments, the human GPR156 nucleic acid portion in a humanized Gpr156 gene comprises the 5' non-coding portion of the first coding exon or the 3' UTR of a human GPR156 gene, or a combination thereof. In specific embodiments, the human GPR156 nucleic acid portion in a humanized Gpr156 gene in an isolated rodent cell or tissue comprises the ATG start codon in the first coding exon through the last exon (i.e., including the 3' UTR) of a human GPR156 gene.

In some embodiments, the rodent Gpr156 nucleic acid portion in a humanized. Gpr156 gene in an isolated rodent cell or tissue comprises a 5' non-coding exonic sequence and/or a 3' non-coding exonic sequence. In embodiments where the rodent cell or tissue is a mouse cell or tissue, the rodent Gpr156 nucleic acid portion in a humanized Gpr156 gene in the isolated mouse cell or tissue may comprise exon 1, the 5' non-coding sequence in exon 2, or the 3' UTR of exon 10 of a mouse Gpr156 gene, or a combination thereof.

In specific embodiments, a humanized Gpr156 gene in an isolated rodent cell or tissue comprises a 5' non-coding exonic sequence of a rodent Gpr156 gene, and the ATG start codon in the first coding exon through the last exon of a human GPR156 gene; and in certain embodiments, such humanized Gpr156 gene further comprises a 3' non-coding exonic sequence of a rodent Gpr156 gene, placed downstream of the last exon of the human GPR156 gene.

In some embodiments, the rodent Gpr156 gene that provides the rodent Gpr156 nucleic acid portion in a humanized Gpr156 gene in an isolated rodent cell or tissue is the endogenous rodent Gpr156 gene.

In some embodiments, a humanized Gpr156 gene is formed from a replacement of a rodent genomic fragment of an endogenous rodent Gpr156 gene at an endogenous rodent Gpr156 locus with a human GPR156 nucleic acid encoding a wild type human GPR156 protein. The human GPR156 nucleic acid can be a genomic DNA or a cDNA.

In some embodiments, the human GPR156 nucleic acid encoding a wild type human GPR156 protein comprises a coding sequence (e.g., a genomic or cDNA sequence) comprising the ATG start codon in the first coding exon through the stop codon in the last coding exon of a human GPR156 gene. In some embodiments, the human GPR156 nucleic acid further comprises a 5' and/or a 3' non-coding exonic sequence of a human GPR156 gene. In some embodiments, the human GPR156 nucleic acid comprises the 5' non-coding portion of the first coding exon or the 3' UTR of a human GPR156 gene, or a combination thereof. In specific embodiments, the human GPR156 nucleic acid comprises the ATG start codon in the first coding exon through the last exon (i.e., including the 3' UTR) of a human GPR156 gene.

In some embodiments, the rodent genomic fragment being replaced comprises the ATG start codon in the first coding exon through the stop codon in the last coding exon of the endogenous rodent Gpr156 gene.

In some embodiments, a humanized Gpr156 gene in an isolated rodent cell or tissue encodes a wild type human GPR156 protein, wherein the wild type protein is a full length wild type human GPR156 protein of 814 amino acids. In some embodiments, the wild type human GPR156 protein comprises the amino acid sequence set forth in SEQ ID NO: 1. In some embodiments, the full length wild type human GPR156 protein comprises the amino acid sequence set forth in SEQ ID NO: 2. In some embodiments, the full length wild type human GPR156 protein comprises an amino acid sequence that is substantially identical to SEQ ID NO: 1 or SEQ ID NO: 2, and comprises Glu at position 533.

In some embodiments, a humanized Gpr156 gene in an isolated rodent cell or tissue encodes a wild type human GPR156 protein that is a short isoform wild type human GPR156 protein of 810 amino acids. In some embodiments, the wild type human GPR156 protein comprises the amino acid sequence set forth in SEQ ID NO: 3. In some embodiments, the wild type human GPR156 protein comprises the amino acid sequence set forth in SEQ ID NO: 4. In some embodiments, the wild type human GPR156 protein comprises an amino acid sequence of 810 amino acids that is substantially identical to SEQ ID NO: 3 or SEQ ID NO: 4 and that comprises Glu at position 529.

In some embodiments, an isolated rodent cell or tissue disclosed herein is heterozygous for a humanized Gpr156 gene. In some embodiments, an isolated rodent cell or tissue disclosed herein is homozygous for a humanized Gpr156 gene.

In some embodiments, an isolated rodent cell or tissue disclosed herein is incapable of expressing an endogenous rodent Gpr156 protein.

In some embodiments, an isolated rodent cell is a rodent embryonic stem (ES) cell.

In some embodiments, an isolated rodent cell or tissue is a mouse cell or tissue, or a rat cell or tissue.

In a further aspect, disclosed herein is a method of making a genetically modified rodent, the method comprising modifying a rodent genome so that the modified genome comprises a humanized Gpr156 gene at an endogenous rodent Gpr156 locus, wherein the humanized Gpr156 gene comprises a rodent Gpr156 nucleic acid portion and a human GPR156 nucleic acid portion, and wherein expression of the humanized Gpr156 gene is under control of the rodent Gpr156 promoter at the endogenous rodent Gpr156 locus; and obtaining a rodent comprising the modified genome.

The rodent Gpr156 nucleic acid portion and the human GPR156 nucleic acid portion each can be a genomic DNA or a cDNA In some embodiments, the humanized Gpr156 gene encodes a mutant human GPR156 protein comprising an E533D variation. In some embodiments, the humanized Gpr156 gene encodes a wild type human GPR156 protein.

In some embodiments, the rodent genome is modified by (a) introducing a targeting vector into a rodent ES cell to obtain a modified rodent ES cell whose genome comprises a humanized Gpr156 gene; and (b) making a rodent using the modified rodent ES cell of (a).

In some embodiments, the targeting vector comprises a human GPR156 nucleic acid which is integrated into an endogenous rodent Gpr156 locus thereby forming a humanized Gpr156 gene an endogenous rodent Gpr156 locus. The human GPR156 nucleic acid can be a genomic DNA or a cDNA.

In some embodiments, the human GPR156 nucleic acid comprises a coding sequence (e.g., a genomic or cDNA sequence) comprising the ATG start codon in the first coding exon through the stop codon in the last coding exon of a human GPR156 gene, wherein the human GPR156 gene comprises nucleotides (in the last coding exon) that encode either Glu (wild type) or an E533D variation (mutant). In some embodiments, the human GPR156 nucleic acid further comprises a 5' and/or a 3' non-coding exonic sequence of a human GPR156 gene. In some embodiments, the human GPR156 nucleic acid comprises the 5' non-coding sequence of the first coding exon or the 3' UTR of a human GPR156 gene, or a combination thereof. In specific embodiments, the human GPR156 nucleic acid comprises the ATG start codon in the first coding exon through the last exon (i.e., including the 3' UTR) of a human GPR156 gene, with human GPR156 gene comprising nucleotides that encode either Glu (wild type) or an E5331) variation (mutant).

In some embodiments, the rodent genomic fragment being replaced comprises the ATG start codon in the first coding exon through the stop codon in the last coding exon of the endogenous rodent Gpr156 gene. In some embodiments, the rodent genomic fragment being replaced further comprises a 5' an/or a 3' non-coding exonic sequence of the endogenous rodent Gpr156 gene. In embodiments where the rodent is a mouse, the mouse genomic fragment being replaced may comprise exon 1, the 5' non-coding sequence in exon 2, or the 3' UTR of exon 10 of the endogenous mouse Gpr156 gene, or a combination thereof.

In some embodiments, a humanized Gpr156 gene encodes a mutant human GPR156 protein comprising an E533D variation, wherein the mutant protein is a full length GPR156 protein of 814 amino acids. In some embodiments, the mutant human GPR156 protein comprises the amino acid sequence set forth in SEQ ID NO: 5. In some embodiments, the mutant human GPR156 protein comprises the amino acid sequence set forth in SEQ ID NO: 6. In some embodiments, the mutant human GPR156 protein comprises an amino acid sequence that is substantially identical to SEQ ID NO: 5 or SEQ ID NO: 6.

In some embodiments, a humanized Gpr156 gene encodes a mutant human GPR156 protein that is a short isoform GPR156 protein of 810 amino acids and comprises an E533D variation. In some embodiments, the mutant human GPR156 protein comprises the amino acid sequence set forth in SEQ ID NO: 7. In some embodiments, the mutant human GPR156 protein comprises the amino acid sequence set forth in SEQ ID NO: 8. In some embodiments, the mutant human GPR156 protein comprises an amino acid sequence that is substantially identical to SEQ ID NO: 7 or SEQ ID NO: 8.

In further embodiments, a humanized Gpr156 gene encodes a wild type human GPR156 protein, wherein the wild type protein is a full length wild type human GPR156 protein of 814 amino acids. In some embodiments, the wild type human GPR156 protein comprises the amino acid sequence set forth in SEQ ID NO: 1. In some embodiments, the full length wild type human GPR156 protein comprises the amino acid sequence set forth in SEQ ID NO: 2. In some embodiments, the full length wild type human GPR156 protein comprises an amino acid sequence that is substantially identical to SEQ ID NO: 1 or SEQ ID NO: 2, and comprises Glu at position 533.

In some embodiments, a humanized Gpr156 gene encodes a wild type human GPR156 protein that is a short isoform wild type human GPR156 protein of 810 amino acids. In some embodiments, the wild type human GPR156 protein comprises the amino acid sequence set forth in SEQ ID NO: 3. In some embodiments, the wild type human GPR156 protein comprises the amino acid sequence set forth in SEQ ID NO: 4. In some embodiments, the wild type human GPR156 protein comprises an amino acid sequence of 810 amino acids that is substantially identical to SEQ ID NO: 3 or SEQ ID NO: 4 and that comprises Glu at position 529.

In some embodiments, a rodent made in accordance with the present method is heterozygous for a humanized Gpr156 gene. In some embodiments, a rodent made in accordance with the present method is homozygous for a humanized Gpr156 gene.

In some embodiments, a rodent made in accordance with the present method is incapable of expressing an endogenous rodent Gpr156 protein.

In some embodiments, a rodent made in accordance with the present method is a mouse or a rat.

In a further aspect, disclosed herein is a targeting nucleic acid vector which comprises a human GPR156 nucleic acid to be integrated into a rodent Gpr156 gene at an endogenous rodent Gpr156 locus, flanked by a 5' nucleotide sequence and a 3' nucleotide sequence that are homologous to nucleotide sequences at the rodent Gpr156 locus, wherein integration of the human GPR156 nucleic acid into the rodent Gpr156 gene results in a replacement of a rodent genomic fragment of an endogenous rodent Gpr156 gene at the endogenous rodent Gpr156 locus with the human GPR156 nucleic acid to form a humanized Gpr156 gene, and wherein expression of the humanized Gpr156 gene is under control of the rodent Gpr156 promoter at the endogenous rodent Gpr156 locus. The human GPR156 nucleic acid (and the humanized Gpr156 gene) encodes either a wild type human GPR156 protein or a mutant human GPR156 protein comprising an E533D variation.

In some embodiments, the human GPR156 nucleic acid in a targeting vector comprises a coding sequence (e.g., a genomic or cDNA sequence) comprising the ATG start codon in the first coding exon through the stop codon in the last coding exon of a human GPR156 gene, wherein the human GPR156 gene comprises nucleotides that encode either Glu (wild type) or Asp (mutant) at an amino acid position corresponding to position 533 in a full length wild type human GPR156 protein (e.g., SEQ ID NO: 1 or 2). In some embodiments, the human GPR156 nucleic acid in a targeting vector comprises the ATG start codon in the first coding exon through the last exon of the human GPR156 gene.

In some embodiments, the targeting vector is designed as such that the rodent genomic fragment of the endogenous rodent Gpr156 gene being replaced comprises the ATG start codon in the first coding exon through the stop codon in the last coding exon of the endogenous rodent Gpr156 gene. In some embodiments, the rodent genomic fragment being replaced further comprises a 5' an/or a 3' non-coding exonic sequence of the endogenous rodent Gpr156 gene. In embodiments where the rodent is a mouse, the targeting vector is designed as such that the mouse genomic fragment being replaced may comprise exon 1, the 5' non-coding sequence in exon 2, or the 3' UTR of exon 10 of the endogenous mouse Gpr156 gene, or a combination thereof.

In some embodiments, the targeting vector is designed to integrate a human GPR156 nucleic acid into the genome of a rodent, wherein the rodent is a mouse or a rat.

In another aspect, disclosed herein is a method comprising breeding a first rodent whose genome comprises a humanized Gpr156 gene at an endogenous rodent Gpr156 locus with a second rodent, resulting in a progeny rodent whose genome comprises the a humanized Gpr156 gene, wherein expression of the humanized Gpr156 gene is under control of the rodent Gpr156 promoter at the endogenous rodent Gpr156 locus.

In some embodiments, the humanized Gpr156 gene encodes a mutant human GPR156 protein comprising an E533D variation. In some embodiments, the humanized Gpr156 gene encodes a wild type human GPR156 protein.

In some embodiments, the first rodent and the second rodent are mice. In some embodiments, the first rodent and the second rodent are rats.

In a further aspect, disclosed is a progeny rodent whose genome comprises a humanized Gpr156 gene at an endogenous rodent Gpr156 locus, wherein the progeny rodent is produced by a method comprising breeding a first rodent whose genome comprises the humanized Gpr156 gene with a second rodent, wherein expression of the humanized Gpr156 gene is under control of the rodent Gpr156 promoter at the endogenous rodent Gpr156 locus.

In some embodiments, the humanized Gpr156 gene encodes a mutant human GPR156 protein comprising an E533D variation. In some embodiments, the humanized Gpr156 gene encodes a wild type human GPR156 protein.

In some embodiments, the progeny rodent is heterozygous for the humanized Gpr156 gene. In some embodiments, the progeny rodent is homozygous for the humanized Gpr156 gene.

In some embodiments, the progeny rodent is a mouse. In some embodiments, the progeny rodent is a rat.

In one aspect, disclosed herein is a rodent whose genome comprises a genetically modified Gpr156 locus, wherein the genetic modification comprises a deletion in an endogenous rodent Gpr156 gene, and optionally also comprises an insertion of a reporter gene, wherein the reporter gene is operably linked to the endogenous rodent Gpr156 promoter at the locus.

In some embodiments, a genomic fragment beginning from the nucleotide after the start codon in the first coding exon through a subsequent coding exon (e.g., the second, third, fourth, fifth, sixth, seventh, eighth, or ninth coding exon) has been deleted; and in some such embodiments, a reporter gene is inserted and is operably linked to the start codon in the first coding exon of the endogenous rodent Gpr156 gene. In these embodiments, expression of the reporter gene resembles the expression pattern of an unmodified endogenous rodent Gpr156 gene.

In some embodiments, the reporter gene is LacZ, or a gene encoding a protein selected the group consisting of luciferase, green fluorescent protein (GFP), enhanced GFP (eGFP), cyan fluorescent protein (CFP), yellow fluorescent protein (YFP), enhanced yellow fluorescent protein (eYFP), blue fluorescent protein (BEI?), enhanced blue fluorescent protein (eBFP), DsRed, and MmGFP.

In some embodiments, the rodent is homozygous for the genetic modification. In some embodiments, the rodent is heterozygous for the genetic modification.

In some embodiments, the rodent is a mouse. In some embodiments, the rodent is a rat.

In another aspect, disclosed is a rodent model of mood disorders such as unipolar depression or anxiety disorders.

In some embodiments, a rodent model of mood disorders comprises a genetically modified rodent whose genome comprises a humanized Gpr156 gene at an endogenous rodent Gpr156 locus, wherein the humanized Gpr156 gene encodes a mutant human GPR156 protein comprising an E533D variation, and wherein expression of the humanized Gpr156 gene is under control of the rodent Gpr156 promoter at the endogenous rodent Gpr156 locus. The rodent can be heterozygous or homozygous for the humanized Gpr156 gene.

In some embodiments, a rodent model of mood disorders further comprises a genetically modified rodent whose genome comprises a humanized Gpr156 gene at an endogenous rodent Gpr156 locus, wherein the humanized Gpr156 gene encodes a wild type human GPR156 protein, and wherein expression of the humanized Gpr156 gene is under control of the rodent Gpr156 promoter at the endogenous rodent Gpr156 locus. The rodent can be heterozygous or homozygous for the humanized Gpr156 gene.

In some embodiments, a rodent model of mood disorders further comprises a genetically modified rodent whose genome comprises a genetically modified Gpr156 locus, wherein the genetic modification comprises a deletion in an endogenous rodent Gpr156 gene and optionally an insertion of a reporter gene, and wherein the reporter gene is operably linked to the endogenous rodent Gpr156 promoter at the locus. The rodent can be heterozygous or homozygous for the genetic modification.

In accordance with this disclosure, a rodent homozygous for a humanized Gpr156 gene that encodes a mutant human GPR156 protein comprising an E533D variation, or homozygous for a deletion in an endogenous rodent Gpr156 gene, is unable to complete a forced swim test, whereas a control rodent (a rodent homozygous for a humanized Gpr156 gene that encodes a wild type human GPR156 protein, or a rodent without genetic modification or humanization) is able to perform a forced swim test. The ability to complete the forced swim test is improved in the E533D mutant rodents or the Gpr156 deletion rodents after treatment with an anti-depression/anti-anxiety drug. Accordingly, the inability to complete a forced swim test in rodents homozygous for a humanized Gpr156 gene encoding an E533D variant, or homozygous for a deletion in an endogenous rodent Gpr156 gene, can serve as a feature or indication of mood disorders, and the rodents can be used to screen or test a therapeutic agent for the treatment of mood disorders such as unipolar depression and anxiety disorders.

In a further aspect, disclosed herein is a method of screening or testing a therapeutic agent for the treatment of unipolar depression or anxiety disorders, the method comprising administering an agent to a rodent disclosed herein, performing one or more assays (e.g., a forced swim test or marble burying test) to determine if the agent has an effect on the rodent's performance in the one or more assays. An agent may be identified as a therapeutic candidate when the agent has a therapeutic effect on the rodent as evaluated by, e.g., reducing, eliminating or preventing the impairment in a forced swim test, or by improving the ability to perform and complete a forced swim test; or by reducing, eliminating or preventing the increase in the number of buried marbles.

BRIEF DESCRIPTION OF THE DRAWINGS

FIG. 3C: Total time of swim test (in seconds) for different Gpr156 genotypes tested before treatment with imipramine, and at 9 weeks after intraperitoneal injection of imipramine 15 mg/kg for 6 days/week (Monday through Saturday), with male and female mice separately plotted. FIG. 3D: Total time of swim test (in seconds) for different GPR156 genotypes tested before and after the treatment with imipramine for 9 weeks, with male and female mice combined for each genotype.

DETAILED DESCRIPTION

Figure 1:
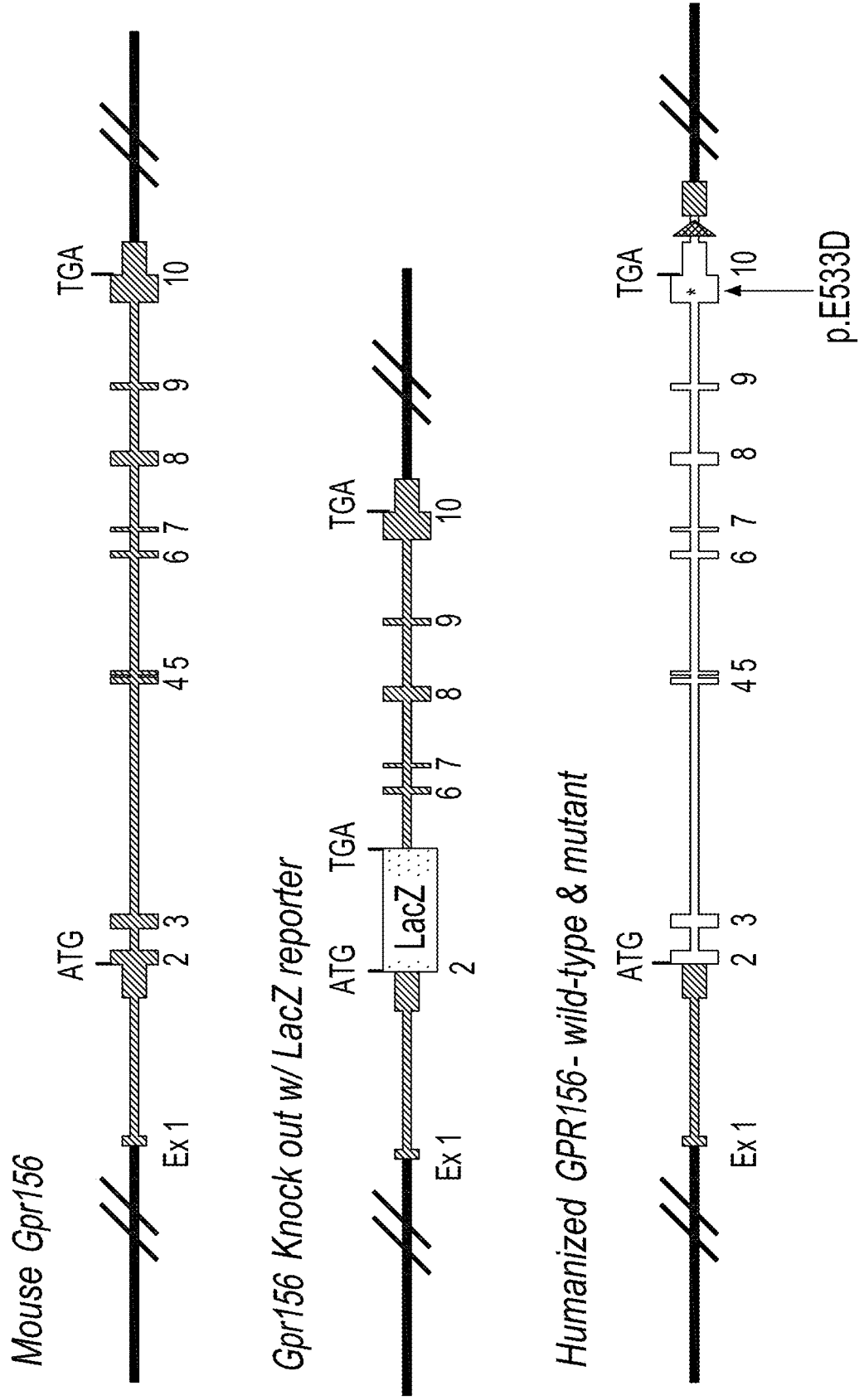
FIG. 1. Top, an endogenous mouse Gpr156 locus (with the coding region depicted in strips); middle, a genetically modified mouse Gpr156 locus with a deletion of mouse Gpr156 exon 2 (in part, from the codon after ATG) and exons 3-5, and insertion of a LacZ coding sequence; and bottom, a genetically modified mouse Gpr156 locus with a replacement of a mouse genomic fragment from the ATG start codon in exon 2 through the stop codon in exon 10 of the mouse Gpr156 gene, with a human genomic fragment from the ATG start codon in the first coding exon through the stop codon in the last coding exon(also the last exon) of a human GPR156 gene (either a wild type human GPR156 gene or a mutant human GPR156 gene encoding the E533D variant). The exon ("Ex") numbering for the humanized Gpr156 gene at the mouse Gpr156 locus depicted in this figure follows the mouse exon numbering.

Disclosed herein are genetically modified rodents suitable for use as an animal model of mood disorders such as unipolar depression and anxiety disorders. In particular, disclosed herein are genetically modified rodent animals (e.g., mouse or rat) that carry a humanized Gpr156 gene at an endogenous rodent Gpr156 locus, wherein the humanized Gpr156 gene encodes a wild type human GPR156 protein or a mutant human GPR156 protein comprising Asp at an amino acid position corresponding to position 533 in a full length wild type human GPR156 protein (also referred to herein as an "E533D variation"). Also disclosed herein are methods and targeting vectors for making a genetically modified rodent, methods of breeding, and use of a genetically modified rodent as an animal model of mood disorders for screening and testing therapeutic agents.

Various aspects of the present disclosure are described in detail in the following sections.

GPR156

GPR156 (G protein-coupled receptor 156) encodes a protein that belongs to group C G protein-coupled receptor family, and is most closely related to the GABA$_B$ receptor subfamily (Calver A, et al., Brain Res. Mol. Brain Res. 110: 305-307 (2003)). The GPR156 protein is predicted to contain seven transmembrane domains, an N-terminal extracellular domain, and a C-terminal intracellular domain, without a signal peptide (Calver et al., supra). The C-terminal sequence of GPR156 contains a putative coiled-coil domain, di-leucine and several RXR(R) ER retention motifs, all of which have been shown to be critical in GABA$_B$ receptor subunit function (Calver et al., supra). In addition, the distribution of GPR156 in the central nervous system is reminiscent of that of the other known GABA$_B$ subunits (Calver et al., supra).

The human GPR156 gene (available, e.g., in GenBank under Accession No. NC_000003.12) is located on chromosome 3, between 3q13 and 3q22, and is about 1.20 kb in length. The human gene has been predicted to have 10 exons, with exon 2 being the first coding exon, although the canonical transcript does not appear to include the 5' non-coding exon present in the predicted transcript, and has 9 exons, with the first exon also being the first coding exon. The homologous mouse gene (available, e.g., in GenBank under Accession No. NC_000082.6) is located on chromosome 16, and is documented as having 10 exons, with exon 2 being the first coding exon. The homologous rat gene (available, e.g., in GenBank under Accession No. NC_005110.4) is located on chromosome 11, and is documented as having 9 exons, with exon 1 being the first coding exon. Exemplary human genomic DNA sequences encoding either a full length or short isoform, a wild type or a E533D variant, human GPR156 protein are set forth in SEQ ID NOS: 9-16. Exemplary rat and mouse transcript cDNA and protein sequences are set forth in SEQ ID NO: 25 (NM_153295.1), SEQ ID NO: 26 (NM_153394.2), SEQ ID NO: 27 (NP_695207.1), and SEQ ID NO: 28 (NP_700443.2).

GPR156 is highly conserved across species, with the mouse and rat proteins being 87.5% identical, and with the mouse and rat proteins being 69.3% and 69.5% identical to the human protein, respectively (Calver et al., supra).

Two wild type isoforms of human GPR156 protein have been reported. The longer isoform, also referred to herein as a full length wild type human GPR156 protein, consists of 814 amino acids. The shorter isoform contains a deletion of 4 amino acids at positions corresponding to positions 198 to 201 of the longer isoform, as a result of an in-frame deletion of 12 nucleotides. For each isoform, two variants exist and have either a glutamic acid or an aspartic acid at an amino acid position corresponding to position 516 in the longer isoform, or corresponding to position 512 in the shorter isoform.

In some embodiments, a full length wild type human GPR156 protein is represented by the amino acid sequence as set forth in SEQ ID NO: 1. In some embodiments, a full length wild type human GPR156 protein is represented by the amino acid sequence as set forth in SEQ ID NO: 2. SEQ ID NO: 1 and SEQ ID NO: 2 both consist of 814 amino acids and differ only in position 516, with SEQ ID NO; 1 having a glutamic acid and SEQ ID NO: 2 having an aspartic acid at this position. In some embodiments, a full length wild type human GPR156 protein may be represented by an amino acid sequence that is substantially identical to the amino acid sequence set forth in SEQ ID NO: 1 or SEQ ID NO: 2.

In referring to a given amino acid sequence as being "substantially identical" to a reference sequence, it includes embodiments where the given amino acid sequence is at least 98% identical, at least 98.5%, at least 99% identical, or at least 99.5% identical, to a reference sequence; for example, a given amino acid sequence differs from a reference sequence by 1, 2, 3, 4, or 5 amino acids, or differs by not more than 5, 4, 3, 2, or 1 amino acid(s).

In some embodiments, a short wild type human GPR156 protein isoform is represented by the amino acid sequence as set forth in SEQ ID NO: 3. In some embodiments, a short wild type human GPR156 protein isoform is represented by the amino acid sequence as set forth in SEQ ID NO: 4. SEQ ID NO: 3 and SEQ ID NO: 4 both consist of 810 amino acids and differ only in position 512, with SEQ ID NO; 3 having a glutamic acid and SEQ ID NO: 4 having an aspartic acid at this position. In some embodiments, a short wild type human GPR156 protein isoform may be represented by an amino acid sequence that is substantially identical to the amino acid sequence set forth in SEQ ID NO: 3 or SEQ ID NO: 4.

All wild type human GPR156 proteins in accordance with this disclosure, both a full length and a short isoform proteins, have a Glu residue at the position corresponding to position 533 in a full length wild type human GPR156 protein (e.g., SEQ ID NO: 1 or SEQ ID NO: 2).

As used herein, the phrase "corresponding to" or grammatical variations thereof when used in the context of the numbering of positions in a given polypeptide or nucleic acid molecule refers to the numbering of a specified reference polypeptide or nucleic acid molecule when the given amino acid or nucleic acid molecule is compared to the reference molecule (e.g., with the reference molecule herein being the polypeptide or nucleic acid molecule of a full length wild type human GPR156). In other words, the position of an amino acid residue or nucleotide in a given polymer is designated with respect to the reference molecule rather than by the actual numerical position of the amino acid residue or nucleotide within the given polymer. For example, a given amino acid sequence can be aligned to a reference sequence by introducing gaps to optimize residue matches between the two sequences. In these cases, although the gaps are present, the numbering of the residue in the given amino acid or nucleic acid sequence is made with respect to the reference sequence to which it has been aligned.

For example, the phrase "GPR156 protein, wherein the protein comprises a glutamic acid at the position corresponding to position 533 of SEQ ID NO: 1" means that, if the amino acid sequence of the GPR156 protein is aligned to the sequence of SEQ ID NO: 1, the GPR156 protein has a glutamic acid at the position that corresponds to position 533 of SEQ ID NO: 1. As an example, the position in the short isoform of wild type GPR156 protein of SEQ ID NO: 3 that correspond to position 533 of SEQ ID NO: 1 is position 529.

As described above, a position within a GPR156 protein that corresponds to position 533 of a full length wild type human GPR156 protein can easily be identified by performing a sequence alignment between the given GPR156 protein and the amino acid sequence of a full length wild type human GPR156 protein (e.g., SEQ ID NO: 1 or SEQ ID NO: 2). A variety of computational algorithms exist that can be used for performing a sequence alignment in order to identify an amino acid position that corresponds to position 533 in SEQ ID NO: 1 or 2. For example, by using the NCBI BLAST algorithm (Altschul et al. 1997 Nucleic Acids Res. 25: 3389-3402) or CLUSTALW software (Sievers and Higgins 2014 Methods Mol. Biol. 1079: 105-116.) sequence alignments may be performed. However, sequences can also be aligned manually.

Alteration/Mutation in Human GPR156 Associated with Unipolar Depression and Anxiety Disorder A rare variant in the human GPR156 gene segregating with the phenotype of unipolar depression in affected family members has been reported in U.S. Published Application 2018/0030114 A1. More specifically, a genetic alteration in the human GPR156 gene that changes the amino acid at the position corresponding to position 533 in a full length human GPR156 protein (e.g., SEQ ID NO: 1 or 2) from Glu to Asp has been identified in US 2018/0030114 A1 as segregating with the phenotype of unipolar depression in affected family members. Such a protein is also referred to herein as a mutant human GPR156 protein with an "E533D mutation" or "E533D variation." Additional family members who carried an E533D variation had confirmed diagnoses of anxiety disorder. Thus, it has been proposed that an E533D variation in human GPR156 is indicative of an increased susceptibility to developing mood disorders such as unipolar depression and an anxiety disorder.

In accordance with this disclosure, an endogenous Gpr156 locus in a rodent has been modified (or humanized) to carry a nucleic acid encoding and expressing a mutant human GPR156 protein comprising an E533D variation, i.e., comprising Asp at a position corresponding to position 533 in a full length wild type human GPR156 protein. As demonstrated herein, such genetically modified rodent exhibits features reflective of mood disorders such as unipolar depression and anxiety disorders, and thus can serve as a rodent model of mood disorders.

Rodents Comprising a Humanized Gpr156 Gene

This disclosure provides genetically modified rodents whose genome comprises a humanized Gpr156 gene at an endogenous rodent Gpr156 locus, wherein the humanized Gpr156 gene encodes a human GPR156 protein and is under control of the rodent Gpr156 promoter at the endogenous rodent Gpr156 locus.

A "humanized Gpr156 gene" as used herein includes a Gpr156 gene that comprises both a human GPR156 nucleic acid portion and a rodent Gpr156 nucleic portion. For example, a rodent Gpr156 gene can be modified to have a portion of the rodent Gpr156 gene replaced by a human GPR156 nucleic acid (e.g., a portion of a human GPR156 gene). In some embodiments, an endogenous rodent Gpr156 gene at an endogenous rodent Gpr156 locus has been modified such that a portion of the endogenous rodent Gpr156 gene at the endogenous rodent Gpr156 locus is replaced by a human GPR156 nucleic acid (e.g., a portion of a human GPR156 gene).

A "portion" of a gene is used herein interchangeably with a "fragment" of a gene, which includes references to contiguous nucleotide sequence portions of a gene, including, for example, a 5' regulatory region (e.g., promoter), a 5' non-coding exonic sequence, a 3' non-coding exonic sequence, a 5' or 3' untranslated region (UTR), an exon in full or in part, an intron in full or in part, a 3' region downstream of the last exon, or combinations thereof. In some embodiments, a portion of a gene refers to the coding region of the gene, e.g., a nucleic acid (genomic DNA or cDNA) comprising the ATG start codon through the stop codon of the gene.

A "nucleic acid," a "nucleic acid molecule," a "nucleic acid sequence," a "nucleotide sequence, "polynucleotide," or "oligonucleotide" can comprise a polymeric form of nucleotides of any length, may include RNA (e.g., mRNA) or DNA (e.g., genomic DNA or cDNA), and can be single-stranded, double-stranded, or multiple stranded. Thus, references to "a human GPR156 nucleic acid" can include, for example, both genomic and cDNA forms of a human GPR156 gene, in full or in part.

In some embodiments, the humanized Gpr156 gene encodes a GPR156 protein that is a wild type human GPR156 protein.

In some embodiments, the wild type human GPR156 protein is a full length wild type human GPR156 protein. In some embodiments, the full length wild type human GPR156 protein is represented by the amino acid sequence as set forth in SEQ ID NO: 1. In some embodiments, the full length wild type human GPR156 protein is represented by the amino acid sequence as set forth in SEQ ID NO: 2. In some embodiments, a full length wild type human GPR156 protein may be represented by an amino acid sequence substantially identical to the amino acid sequence set forth in SEQ ID NO: 1 or SEQ ID NO: 2.

In some embodiments, the wild type human GPR156 protein is a short isoform wild type human GPR156 protein. In some embodiments, the short isoform wild type human GPR156 protein is represented by the amino acid sequence as set forth in SEQ ID NO: 3. In some embodiments, the short isoform wild type human GPR156 protein is represented by the amino acid sequence as set forth in SEQ ID NO: 4. In some embodiments, a short isoform wild type human GPR156 protein may be represented by an amino acid sequence substantially identical to the amino acid sequence set forth in SEQ ID NO: 3 or SEQ ID NO: 4.

In some embodiments, the humanized Gpr156 gene encodes a full length GPR156 protein of 814 amino acids, wherein the GPR156 protein comprises a Glu residue at a position corresponding to position 533 in a full length wild type human GPR156 protein (e.g., SEQ ID NO: 1 or SEQ ID NO: 2), and wherein the GPR156 protein comprises an amino acid sequence substantially identical to the amino acid sequence set forth in SEQ ID NO: 1 or SEQ ID NO: 2.

In some embodiments, the humanized Gpr156 gene encodes a short isoform GPR156 protein of 810 amino acids, wherein the GPR156 protein comprises Glu at the position corresponding to position 533 in a full length wild type human GPR1.56 protein (e.g., SEQ ID NO: 1 or SEQ ID NO: 2), and wherein the GPR156 protein comprises an amino acid sequence substantially identical to the amino acid sequence set forth in SEQ ID NO: 3 or SEQ ID NO: 4.

In some embodiments, the humanized Gpr156 gene encodes a mutant human GPR156 protein comprising an E533D variation, i.e., a mutant human GPR156 protein comprising Asp at an amino acid position corresponding to position 533 in a full length wild type human GPR156 protein (e.g., SEQ ID NO: 1 or 2). In some embodiments, an E533D variation is the only variation in a mutant human GPR156 protein as compared to a wild type human GPR156 protein, in which case the mutant GPR156 protein is also referred to as an E533D variant.

In some embodiments, the mutant human GPR156 protein is a full length human GPR156 protein. In some embodiments, the full length mutant human GPR156 protein is represented by the amino acid sequence as set forth in SEQ ID NO: 5. In some embodiments, the full length mutant human GPR156 protein is represented by the amino acid sequence as set forth in SEQ ID NO: 6. In some embodiments, a full length mutant human GPR156 protein may be represented by an amino acid sequence substantially identical to the amino acid sequence set forth in SEQ ID NO: 5 or SEQ ID NO: 6.

In some embodiments, the mutant human GPR156 protein is a short isoform human GPR156 protein. In some embodiments, the short isoform mutant human GPR156 protein is represented by the amino acid sequence as set forth in SEQ ID NO: 7. In some embodiments, the short isoform mutant human GPR156 protein is represented by the amino acid sequence as set forth in SEQ ID NO: 8. In some embodiments, a short isoform mutant human GPR156 protein may be represented by an amino acid sequence substantially identical to the amino acid sequence set forth in SEQ ID NO: 7 or SEQ ID NO: 8.

In some embodiments, the humanized Gpr156 gene encodes a full length mutant GPR156 protein of 814 amino acids, wherein the full length mutant GPR156 protein comprises an E533D variation, and comprises an amino acid sequence substantially identical to the amino acid sequence set forth in SEQ ID NO: 5 or SEQ ID NO: 6.

In some embodiments, the humanized Gpr156 gene encodes a short isoform mutant GPR156 protein of 810 amino acids, wherein the GPR156 protein comprises an E533D variation, and wherein the mutant GPR156 protein comprises an amino acid sequence substantially identical to the amino acid sequence set forth in SEQ ID NO: 7 or SEQ ID NO: 8.

As stated above, a humanized Gpr156 gene can include a human GPR156 nucleic acid portion and a rodent Gpr156 nucleic acid portion.

In some embodiments, the human GPR156 nucleic acid portion in a humanized Gpr156 gene comprises a coding sequence for a GPR156 protein as described hereinabove, e.g., a wild type human GPR156 protein (either a full length or short isoform), or a mutant human GPR156 protein (either a full length or short isoform).

In some embodiments, the coding sequence is in the form of a genomic DNA. In some embodiments, the coding sequence is in the form of a cDNA (i.e., without intronic sequences). Examples of nucleic acid sequences suitable for use in providing a coding sequence are set forth in SEQ ID NOS: 9-24, with their correspondence to protein sequences being summarized below.

TABLE 1

| Human GPR156 | Amino Acid Sequence | Genomic Sequence | cDNA Sequence |
| --- | --- | --- | --- |
| Wild type full length | SEQ ID NO: 1, 814 amino acids, Glu at position 516. | SEQ ID NO: 9, 120450 nt, Codon GAA or GAG at 117164-117166 encodes Glu. | SEQ ID NO: 17 |
| Wild type full length | SEQ ID NO: 2, 814 amino acids, Asp at position 516. | SEQ ID NO: 10, 120450 nt, Codon GAT or GAC at 117164-117166 encodes Asp. | SEQ ID NO: 18 |
| Wild type short isoform | SEQ ID NO: 3, 810 amino acids, Glu at position 512. | SEQ ID NO: 11, 120438 nt, Codon GAA or GAG at 117152-117154 encodes Glu. | SEQ ID NO: 19 |
| Wild type short isoform | SEQ ID NO: 4, 810 amino acids, Asp at position 512. | SEQ ID NO: 12, 120438 nt, Codon GAT or GAC at 117152-117154 encodes Asp. | SEQ ID NO: 20 |
| Mutant full length | SEQ ID NO: 5, 814 amino acids, Glu at position 516, and E533D at position 533. | SEQ ID NO: 13, 120450 nt, Codon GAA or GAG at 117164-117166 encodes Glu, and codon GAT or GAC at 117,215-117,217 encodes Asp (E533D). | SEQ ID NO: 21 |
| Mutant full length | SEQ ID NO. 6, 814 amino acids. Asp at position 516, and E533D at position 533. | SEQ ID NO: 14, 120450 nt, Codon GAT or GAC at 117164-117166 encodes Asp, and codon GAT or GAC at 117,215-117,217 encodes Asp (E533D). | SEQ ID NO: 22 |
| Mutant short isoform | SEQ ID NO: 7, 810 amino acids, Glu at position 512, and E533D at position 529. | SEQ ID NO: 15, 120438 nt, Codon GAA or GAG at 117152-117154 encodes Glu, and codon GAT or GAC at 117,203-117,205 encodes Asp (E533D). | SEQ ID NO: 23 |
| Mutant short isoform | SEQ ID NO: 8, 810 amino acids. Asp at position 512, and E533D at position 529. | SEQ ID NO: 16, 120438 nt, Codon GAT or GAC at 117152-117154 encodes Asp, and codon GAT or GAC at 117,203-117,205 encodes Asp (E533D). | SEQ ID NO: 24 |

In some embodiments, the human GPR156 nucleic acid portion in a humanized Gpr156 gene comprises a coding sequence comprising the ATG start codon in the first coding exon through the stop codon in the last coding exon (also the last exon) of a human GPR156 gene. The human GPR156 gene can be a wild type gene with the last coding exon encoding Glu at the amino acid position corresponding to position 533 of a full length wild type GPR156 protein, or a mutant gene with the last coding exon encoding Asp at the amino acid position corresponding to position 533 of a full length wild type GPR156 protein.

In some embodiments, the human GPR156 nucleic acid portion in a humanized Gpr156 gene further comprises, in addition to a coding sequence for a GPR156 protein, a 5' non-coding exonic sequence (e.g., the 5' portion of the first coding exon upstream of the ATG start), a 3' non-coding exonic sequence (e.g., the 3' portion of the last exon downstream of the stop codon, i.e., the 3' UTR), a nucleotide sequence downstream of the last exon of a human GPR156 gene, or a combination thereof.

In a humanized Gpr156 gene of this disclosure, the human GPR156 nucleic acid portion is operably linked to the rodent Gpr156 nucleic acid portion. In some embodiments, the rodent Gpr156 nucleic acid portion in a humanized Gpr156 gene can include a 5' non-coding exonic sequence or a 3' non-coding exonic sequence of a rodent Gpr156 gene, or a combination thereof. In embodiments where a rodent Gpr156 gene is a mouse Gpr156 gene, a 5' non-coding exonic sequence can include, for example, exon 1, the 5' non-coding portion of exon 2 (the first coding exon), or a combination thereof, of the mouse Gpr156 gene; and a 3' non-coding exonic sequence can include, for example, the 3' UTR of exon 10 (the 9th and last coding exon) of the mouse Gpr156 gene. In embodiments where a rodent Gpr156 gene is a rat Gpr156 gene, a 5' non-coding exonic sequence can include, for example, the 5' non-coding portion of exon 1 (also being the first coding exon) of the rat Gpr156 gene; and a 3' non-coding exonic sequence can include, for example, the 3' UTR of exon 9 (also being last coding exon and last exon) of the rat Gpr156 gene.

In some embodiments, a humanized Gpr156 gene comprises the 3' UTR of a human GPR156 gene. In some embodiments, a humanized Gpr156 gene comprises a 3' non-coding exonic sequence (e.g., the 3' UTR) of a rodent Gpr156 gene. In some embodiments, a humanized Gpr156 gene comprises both the 3' UTR of a human GPR156 gene and the 3' UTR of a rodent Gpr156 gene, with the rodent 3' UTR placed downstream of the 3' UTR of the human GPR156 gene.

In some specific embodiments, a humanized Gpr156 gene comprises a 5' non-coding exonic sequence of a rodent Gpr156 gene, operably linked to a human GPR156 nucleic acid comprising the ATG start codon in the first coding exon through the last exon (i.e., including the 3' UTR) of a human GPR156 gene, following by a 3' non-coding exonic sequence of a rodent Gpr156 gene. In particular embodiments, a humanized Gpr156 gene comprises exon 1 and the 5' non-coding portion of exon 2 (the first coding exon) of a mouse Gpr156 gene, operably linked to a human GPR156 nucleic acid comprising the ATG start codon through the last exon (i.e., including the 3' UTR) of a human GPR156 gene, following by the 3' UTR of exon 10 of a mouse Gpr156 gene.

In some embodiments, a humanized Gpr156 gene is formed from a replacement of a rodent genomic fragment of an endogenous rodent Gpr156 gene at an endogenous rodent Gpr156 locus with a human GPR156 nucleic acid encoding either a wild type human GPR156 protein or a mutant human GPR156 protein comprising an E533D variation. The human GPR156 nucleic acid portion can be a genomic DNA or a cDNA.

In some embodiments, the human GPR156 nucleic acid encoding a human GPR156 protein comprises a human genomic fragment comprising the ATG start codon in the first coding exon through the stop codon in the last coding exon of a human GPR156 gene, wherein the human GPR156 gene comprises nucleotides that encode either a Glu residue (wild type) or an E533D variation. In some embodiments, the human GPR156 nucleic acid further comprises a 5' non-coding exonic sequence (e.g., the 5' non-coding sequence in the first coding exon), or a 3' non-coding exonic sequence (e.g., the 3' UTR), of a human GPR156 gene, or a combination thereof. In specific embodiments, the human GPR156 nucleic acid comprises the ATG start codon the first coding exon through the last exon (i.e., including the 3' UTR) of a human GPR156 gene.

In some embodiments, the rodent genomic fragment being replaced comprises the ATG start codon in the first coding exon through the stop codon in the last coding exon of the endogenous rodent Gpr156 gene. In some embodiments, the rodent genomic fragment being replaced further comprises a 5' and/or a 3' non-coding exonic sequence of the endogenous rodent Gpr156 gene. In embodiments where the rodent is a mouse, the mouse genomic fragment being replaced may also comprise exon 1, the 5' non-coding sequence in exon 2, or the 3' UTR of exon 10 of the endogenous mouse Gpr156 gene, or a combination thereof.

In some embodiments, a rodent animal disclosed herein that comprises a humanized Gpr156 gene in an endogenous rodent Gpr156 locus can be heterozygous or homozygous for the humanized Gpr156 gene.

In some embodiments, a rodent animal disclosed herein is incapable of expressing an endogenous rodent Gpr156 protein. For example, a rodent is provided where the endogenous rodent Gpr156 gene is disrupted or deleted or modified or replaced with a humanized Gpr156 gene. In some embodiments, a genomic fragment in each of the two endogenous rodent Gpr156 alleles has been replaced with a human GPR156 nucleic acid, resulting in two humanized Gpr156 alleles and a rodent animal incapable of expressing an endogenous rodent Gpr156 protein. In some embodiments, a genomic fragment of one endogenous rodent Gpr156 allele has been replaced with a human GPR156 nucleic acid, and the other endogenous rodent Gpr156 allele has been modified to contain a disruption or deletion, resulting in a rodent animal incapable of expressing an endogenous rodent Gpr156 protein.

Also provided herein are rodents whose genome comprises a genetically modified Gpr156 locus, wherein the genetic modification comprises a deletion in an endogenous rodent Gpr156 gene, and optionally also comprises an insertion of a reporter gene, and wherein the reporter gene is operably linked to the endogenous rodent Gpr156 promoter at the locus. The rodent can be heterozygous or homozygous for the genetic modification.

In some embodiments, a genomic fragment beginning from the nucleotide immediately after the start codon in the first coding exon through a subsequent coding exon (e.g., the second, third, fourth, fifth, sixth, seventh, eighth, or ninth coding exon) has been deleted, and the reporter gene is inserted immediately downstream of the start codon of the endogenous rodent Gpr156 gene. In such linkage, expression of the reporter gene is expected to resemble the expression pattern of an unmodified endogenous rodent Gpr156 gene.

Multiple reporter genes are known in the art and are suitable for use herein. In some embodiments, the reporter gene is a LacZ gene. In some embodiments, the reporter gene is a gene encoding a protein selected the group consisting of luciferase, green fluorescent protein (GFP), enhanced GFP (eGFP), cyan fluorescent protein (CFP), yellow fluorescent protein (YFP), enhanced yellow fluorescent protein (eYFP), blue fluorescent protein (BFP), enhanced blue fluorescent protein (eBFP), DsRed, and MmGFP.

For any of the embodiments described herein, the rodents can include, for example, mice, rats, and hamsters.

In some embodiments, the rodent is a mouse. In some embodiments, the rodent is a mouse of a C57BL strain, for example, a C57BL strain selected from C57BL/A, C57BL/An, C57BL/GrFa, C57BL/KaLwN, C57BL/6, C57BL/6J, C57BL/6ByJ, C57BL/6NJ, C57BL/10, C57BL/10ScSn, C57BL/10Cr, and C57BL/Ola. In other embodiments, the rodent is a mouse of a 129 strain, for example, a 129 strain selected from the group consisting of 129P1, 129P2, 129P3, 129X1, 129S1 (e.g., 129S1/SV, 129S1/SvIm), 129S2, 129S4, 129S5, 129S9/SvEvH, 129/SvJae, 129S6 (129/SvEvTac), 129S7, 129S8, 129T1, 129T2 (see, e.g., Festing et al. (1999), *Mammalian Genome* 10:836; Auerbach et al. (2000), *Biotechniques* 29(5):1024-1028, 1030, 1032). In some embodiments, the rodent is a mouse that is a mix of an aforementioned 129 strain and an aforementioned C57BL/6 strain. In certain embodiments, the mouse is a mix (i.e., hybrid) of aforementioned 129 strains, or a mix of aforementioned C57BL strains, or a mix of a C57BL strain and a 129 strain. In certain embodiments, the mouse is a mix of a C57BL/6 strain with a 129 strain. In specific embodiments, the mouse is a VGF1 strain, also known as F1H4, which is a hybrid of C57BL/6 and 129. In other embodiments, the mouse is a BALB strain, e.g., BALB/c strain. In some embodiments, the mouse is a mix of a BALB strain and another aforementioned strain.

In some embodiments, the rodent is a rat. In certain embodiments, the rat is selected from a Wistar rat, an LEA strain, a Sprague Dawley strain, a Fischer strain, F344, F6, and Dark Agouti. In other embodiments, the rat is a mix of two or more strains selected from the group consisting of Wistar, LEA, Sprague Dawley, Fischer, F344, F6, and Dark Agouti.

Targeting Vectors, Methods for Making a Rodent Comprising a Humanized Gpr156 Gene, and Methods of Breeding Rodents comprising a humanized Gpr156 gene can be made using various methods. In some embodiments, a targeting nucleic acid construct (i.e., a targeting vector) carrying a human GPR156 nucleic acid is constructed. The human GPR156 nucleic acid can include a coding sequence for a GPR156 protein as described hereinabove, e.g., a wild type human GPR156 protein (either a full length or a short isoform), or a mutant human GPR156 protein (either a full length or a short isoform). Depending on size (e.g., whether a genomic DNA or cDNA is used), a human GPR156 nucleic acid can be cloned directly from cDNA sources or synthetically made. Alternatively, bacterial artificial chromosome (BAC) libraries can provide human GPR156 nucleic acid sequences.

The targeting vector can include, in addition to a human GPR156 nucleic acid, flanking nucleic acid sequences that are of suitable lengths and homologous to rodent Gpr156 gene sequences at an endogenous rodent Gpr156 locus so as to be capable of mediating homologous recombination and integration of the human GPR156 nucleic acid into the endogenous rodent Gpr156 gene, forming a humanized Gpr156 gene at an endogenous rodent Gpr156 locus.

In some embodiments, the targeting vector also includes a selectable marker gene (e.g., a self deleting cassette containing a selectable marker gene, as described in U.S. Pat. Nos. 8,697,851, 8,518,392 and 8,354,389, all of which are incorporated herein by reference), which can be flanked by or comprises site-specific recombination sites (e.g., loxP, Frt, etc.). The selectable marker gene can be placed on the targeting vector adjacent to the human GPR156 nucleic acid to permit easy selection of transfectants.

In some embodiments, a targeting vector (such as a BAC vector) carrying a human GPR156 nucleic acid can be introduced into rodent embryonic stem (ES) cells by, e.g., electroporation. Both mouse ES cells and rat ES cells have been described in the art. See, e.g., U.S. Pat. Nos. 7,576,259, 7,659,442, 7,294,754, and US 2008-0078000 A1 (all of which are incorporated herein by reference) describe mouse ES cells and the VELOCIMOUSE® method for making a genetically modified mouse; and US 2014/0235933 A1 and US 2014/0310828 A1 (all of which are incorporated herein by reference) describe rat ES cells and methods for making a genetically modified rat.

ES cells having the human GPR156 nucleic acid integrated in the rodent genome can be selected. After selection, positive ES clones can be modified, e.g., to remove a self deleting cassette, if desired. ES cells having the human GPR156 nucleic acid sequence integrated in the genome are then used as donor ES cells for injection into a pre-morula stage embryo (e.g., 8-cell stage embryo) by using the VELOCIMOUSE® method (see, e.g., U.S. Pat. Nos. 7,576, 259, 7,659,442, 7,294,754, and US 2008-0078000 A1), or methods described in US 2014/0235933 A1 and US 2014/0310828 A1. The embryo comprising the donor ES cells is incubated until blastocyst stage and then implanted into a surrogate mother to produce an F0 rodent fully derived from the donor ES cells. Rodent pups bearing the mutant allele can be identified by genotyping of DNA isolated from tail snips using a modification of allele (MOA) assay (Valenzuela et al., supra) that detects the presence of the human GPR156 nucleic acid sequence or a selectable marker gene.

Further provided herein are methods of breeding a genetically modified rodent as described herein with another rodent, as well as progenies obtained from such breeding.

In some embodiments, a method is provided which comprises breeding a first genetically modified rodent as described hereinabove (e.g., a rodent whose genome comprises a humanized Gpr156 gene at an endogenous rodent Gpr156 locus wherein expression of the humanized Gpr156 gene is under control of the rodent Gpr156 promoter at the endogenous rodent Gpr156 locus), with a second rodent, resulting in a progeny rodent whose genome comprises the humanized Gpr156 gene. As described above, a humanized Gpr156 gene can encode a wild type human GPR156 protein, or a mutant human GPR156 protein comprising an E533D variation. The progeny may possess other desirable phenotypes or genetic modifications inherited from the second rodent used in the breeding. In some embodiments, the progeny rodent is heterozygous for the humanized Gpr156 gene. In some embodiments, the progeny rodent is homozygous for the humanized Gpr156 gene.

In some embodiments, a progeny rodent is provided whose genome comprises a humanized Gpr156 gene at an endogenous rodent Gpr156 locus, wherein the progeny rodent is produced by a method comprising breeding a first genetically modified rodent as described hereinabove (e.g., a rodent whose genome comprises a humanized Gpr156 gene at an endogenous rodent Gpr156 locus wherein expression of the humanized Gpr156 gene is under control of the rodent Gpr156 promoter at the endogenous rodent Gpr156 locus), with a second rodent. In some embodiments, the progeny rodent is heterozygous for the humanized Gpr156 gene. In some embodiments, the progeny rodent is homozygous for the humanized Gpr156 gene.

Rodent Model of Mood Disorders

Disclosed herein are rodent models of mood disorders such as unipolar depression and anxiety disorders.

According to the Diagnostic and Statistical Manual of Mental Disorders-Fifth Edition (DSM-V), published by the American Psychiatric Association, Washington D.C., 2013, unipolar depression consists of: major depressive disorder, dysthymic disorder, mixed depressive disorder, adjustment disorder with depressed mood, and depression not otherwise specified (NOS). DSMIV criteria for depression is for 2 weeks or more, five or more symptoms from the following: i) feeling depressed mood most of the day nearly every day; ii) markedly diminished interest or pleasure in all or almost all activities; iii) significant weight loss or decreased appetite; iv) insomnia or hypersomnia; v) psychomotor agitation or retardation; vi) fatigue or loss of energy; vii) feelings of worthlessness or excessive guilt; viii) diminished ability to think or concentrate or indecisiveness; and ix) recurrent thoughts of death. DSMIV criteria for dysthymic disorder is characterized by an overwhelming yet chronic state of depression, exhibited by a depressed mood for most of the days, for more days than not, for at least 2 years. The person who suffers from this disorder must not have gone for more than 2 months without experiencing two or more of the following symptoms: poor appetite or overeating; ii) insomnia or hypersomnia; iii) low energy or fatigue; iv) low self-esteem; v) poor concentration or difficulty making decisions; and vi) feelings of hopelessness.

Physiological symptoms of an anxiety disorder include, but are not limited to, muscle tension, heart palpitations, sweating, dizziness, and shortness of breath. Emotional symptoms include, but are not limited to, restlessness, a sense of impending doom, fear of dying, fear of embarrassment or humiliation, and fear of something terrible happening.

In some embodiments, a rodent model of mood disorders comprises a genetically modified rodent whose genome comprises a humanized Gpr156 gene at an endogenous rodent Gpr156 locus, wherein the humanized Gpr156 gene encodes a mutant human GPR156 protein comprising an E533D variation, and wherein expression of the humanized Gpr156 gene is under control of the rodent Gpr156 promoter at the endogenous rodent Gpr156 locus.

In some embodiments, a rodent model of mood disorders further comprises a genetically modified rodent whose genome comprises a humanized Gpr156 gene at an endogenous rodent Gpr156 locus, wherein the humanized Gpr156 gene encodes a wild type human GPR156 protein, and wherein expression of the humanized Gpr156 gene is under control of the rodent Gpr156 promoter at the endogenous rodent Gpr156 locus. Such rodent has been shown herein to be able to complete a forced swim test, similar to a wild type rodent (without any humanization), and is therefore useful as an additional control rodent to be compared to.

In some embodiments, a rodent model of mood disorders further comprises a genetically modified rodent whose genome comprises a genetically modified Gpr156 locus, wherein the genetic modification comprises a deletion in an endogenous rodent Gpr156 gene and optionally an insertion of a reporter gene, and wherein the reporter gene is operably linked to the endogenous rodent Gpr156 promoter at the locus. The rodent can be heterozygous or homozygous for the genetic modification. A rodent homozygous for a deletion in an endogenous rodent Gpr156 gene has been shown herein to be unable to complete a forced swim test and have an increase in the number of marbles buried within a specified time and is therefore useful as an additional control rodent to be compared to.

In some embodiments, a genetically modified rodent is assessed in a forced swim test. In exemplary embodiments of a forced swim test, rodents can be placed in a container or beaker filled with water to ensure rodents cannot touch the bottom of the container even with their tail. The water can be kept at room temperature or at 30° C. The test can last for about 5, 5.5, 6, 6.5, 7, 7,5, 8, 8.5, 9, 9.5, or 10 minutes. In some embodiments, the test lasts about 6 min. If a rodent is unable to perform the test (e.g., unable to stay afloat before the test period ends), it is pulled out of the water as soon as it shows signs of distress. As established herein, the inability to perform a forced swim test by a rodent homozygous for the humanized Gpr156 gene encoding an E533D variation or homozygous for the deletion of the endogenous rodent Gpr156 gene is a characteristic reflective of mood disorders such as depression or anxiety. A wild type rodent (expressing endogenous rodent Gpr156) and a genetically modified rodent homozygous for a humanized Gpr156 gene (without the E533D mutation) have no difficulty in completing a swim test and can be used as controls. In some embodiments, an improvement in the ability to perform the swim test can be determined based on evaluating an individual rodent, e.g., at different time points, or before and after a treatment. In some embodiments, an improvement in the ability to perform the swim test is determined based on evaluating a group of rodents having the same genetic modification, e.g., at different time points, or before and after a treatment, and an increase in the percentage of rodents in the group that can successfully perform the test indicates an improved ability. A change in the ability to perform the swim test (e.g., an increase or improvement) can be determined based on comparison of a treated group of rodents relative to a separated untreated group of rodents having the same genotype, or based on comparison of a group of rodents before a treatment relative to the same group of rodents after the treatment.

The Forced Swim Test (or Porsolt Test, Porsolt et al., Arch Int Pharmacodyn Ther. 229(2):327-336 (1977)) is used in the art to assess helplessness based on how a rodent reacts to an unpleasant environment. Helplessness is a characteristic feature in depression. A rodent (e.g., a mouse) that is placed in water typically tries to escape. However, if the rodent exhibits a depressive behavior, the rodent will simply float without attempting to escape until rescued. Learned helplessness is a phenomenon discovered and explored initially by Seligman and his colleagues in the 1970s (Seligman, Annu Rev Med. 23(1):407-412 (1972)). One of the major attractions of this model is that it is derived from the cognitive view of depression in which events are viewed negatively and interpreted as not controllable, leading to feelings of anxiety and helplessness when dealing with them. There are many similarities between the learned helplessness in animal and human depression. For example, uncontrollable stressful events, which precipitate depression-like behaviors observed in rodents, similarly precede the onset of some clinical depression in humans (Gold et al., N Eng J Med. 319(6):348-353 (1988); Lloyd, Arch Gen Psychiatry 37(5):541-548 (1980)). Moreover, exposure of animals to similar but controllable events does not produce relevant behavioral changes (Corum and Thurmond, Psychosom Med. 39(6):436-43 (1977); Weiss et al., A model for neurochemical study of depression. In M. Spiegelstein and A. Levy Eds., Elsevier, Amsterdam, 1982, pp. 195-223). As described in the art, the Porsolt Forced Swim test extends over a two-day period, with the first day being the training day and the second day being the testing day. During the training trial, animals learn that escape from the tank is not possible. On the test day ($2^{nd}$ day), animals are placed into the container of water for five minutes. During the second day, the amount of time the animals spend immobile is measured as the dependent variable.

It has been shown herein that genetically modified mice homozygous for the humanized Gpr156 gene encoding an E533D variation and genetically modified mice homozygous for the deletion of the mouse Gpr156 gene were unable to perform a 6 minute forced swim test corresponding to the training session. The mice were initially able to swim but after a couple of minutes of trying to find an escape, it appeared as if mice "panicked" in the water. These mice then started to display an abnormal behavior characterized by frenetic swimming, repetitive diving and spinning under water and become unable to stay afloat. If not quickly retrieved out of the water, these mice drown. In contrast, a wild type mouse (expressing endogenous mouse Gpr156) and a genetically modified mouse homozygous for the humanized Gpr156 gene (without the mutation) had no difficulty completing the 6 minutes swim test.

The peculiar behavior displayed by genetically modified mice homozygous for the humanized Gpr156 gene encoding an E533D variation or genetically modified mice homozygous for the deletion of the mouse GPR156 gene has not been described by others in the literature. Due to the fact that these mice are unable to complete the test, the inventors were not able to measure learned helplessness. However, the inventors observed that 90% of female and 60% of male genetically modified mice that are homozygous for the humanized Gpr156 gene encoding an E533D variation failed the training swim session while genetically modified mice homozygous for a humanized Gpr156 gene encoding a wild type human GPR156 protein easily completed the test. Similarly, 90% of female and 53% of male genetically modified mice homozygous for a deletion of the mouse Gpr156 gene failed the training swim session while their wild-type littermates completed the test. Similar results were obtained when the swim test training session was run in water heated at 30° C. instead of room temperature ($\approx$23° C.) or when using a water maze apparatus which is bigger and presents with a platform (escape option).

It has also been shown herein that rodents homozygous for the humanized Gpr156 gene encoding an E533D variation improved on their ability to perform the swim test after treatment with fluoxetine (a selective Serotonin reuptake inhibitor) or with imipramine (an inhibitor of reuptake of norepinephrine, acetylcholine, dopamine and serotonine). Improvement in the ability to perform a 6-minute swim test has been observed for $GPR156^{E533D/E533D}$ mice after treatment with fluoxetine (10 mg/kg, i.p., daily) or imipramine (15 mg/kg, i.p., daily, six days/week) for 9 weeks.

In some embodiments, a genetically modified rodent is assessed in a marble burying test. Marble burying task is used as an indicator of obsessive compulsive-like behavior and/or anxiety-like behavior. Rodents with OCD-like symptoms tend to engage in a high degree of repetitive behavior (including digging) and rodents with a high degree of anxiety tend to engage in a high degree of digging in novel contexts.

In some embodiments, a marble burying test can be performed as follows. Rodent cages can be evenly filled with corn cob bedding and marbles are evenly spaced on top of the bedding. Each rodent is placed at the center of the cage and the test is run for about 10 minutes. After 10 min, the animals are removed from cages and the marbles at least two-thirds buried are counted.

Figure 4:
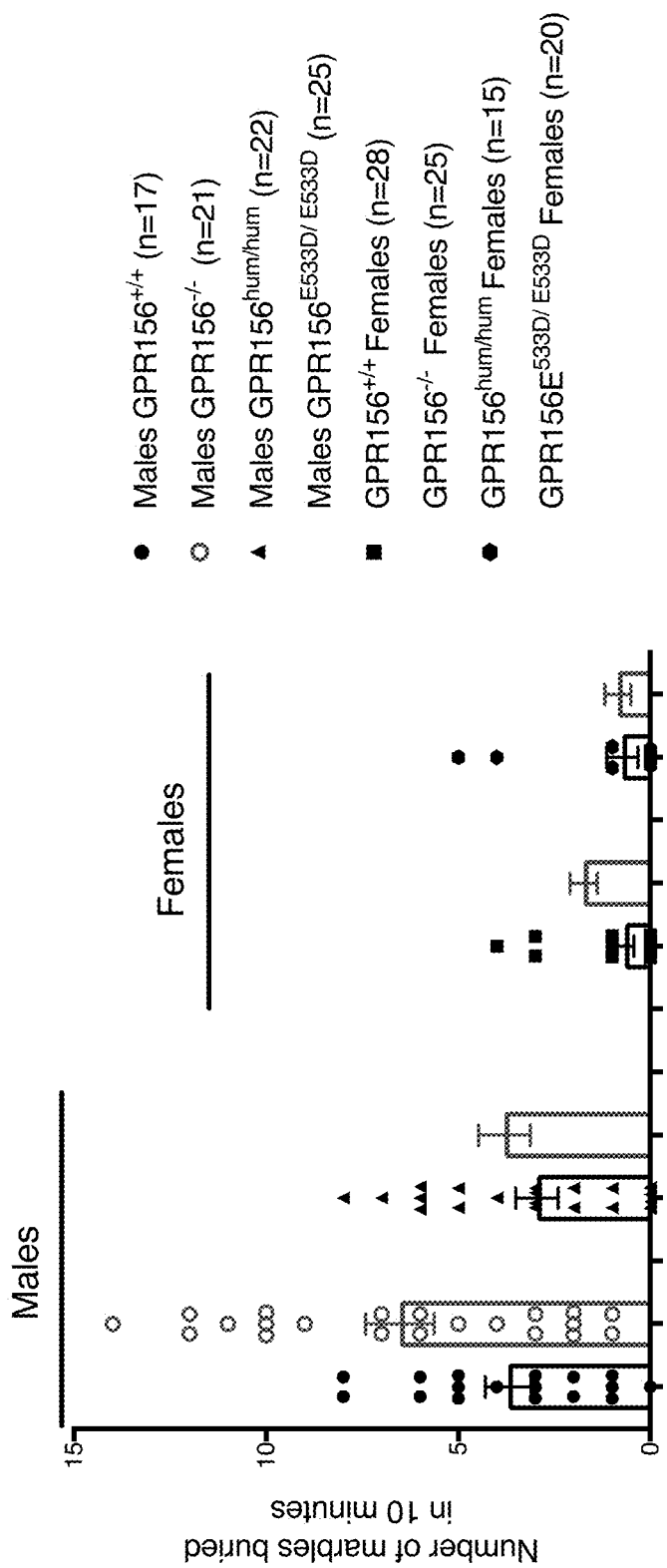
FIG. 4. Number of marbles buried in 10 minutes by mice of different genotypes, from left to right: male Gpr156$^{+/+}$, male Gpr156$^{-/-}$, male GPR156$^{hum/hum}$, male GPR156$^{E533D/E533D}$, female Gpr156$^{+/+}$, female Gpr156$^{-/-}$, female GPR156$^{hum/hum}$, and female GPR156$^{E533D/E533D}$. Male mice genetically modified and homozygous for the humanized GPR156 gene encoding an E533D variation or homozygous for the deletion of the mouse Gpr156 gene showed an increase in the number of marbles buried in 10 minutes. Data are expressed as mean±SEM for each animal group.

As examples, it has been shown herein that genetically modified male mice homozygous for the humanized Gpr156 gene encoding an E533D variation or homozygous for the deletion of the mouse GPR156 gene exhibited a trend toward an increase in the number of marbles buried in 10 minutes (see e.g., FIG. 4).

The rodents and models disclosed herein permit a better understanding of the function of the GPR156 protein and the development of mood disorders. In addition, such rodents may be used in the screening, testing and development of therapeutic agents for the treatment of mood disorders such as unipolar depression or anxiety disorders.

In some embodiments, an effect of a therapeutic agent for treating unipolar depression or an anxiety disorder is determined herein by administering the agent to a rodent disclosed herein, e.g., a rodent carrying a humanized Gpr156 gene encoding an E533D variant, subjecting the rodent to one or more tests a forced swim test or marble burying test), and determining whether the candidate therapeutic agent has any effect on the performance of the rodent in the test, e.g., any improvement on the ability to complete the swim test, or any decrease in the number of marbles buried in a marble burying test.

Therapeutic agents that can be tested in a rodent disclosed herein include both commercially available antidepressants and anxiolytics, and candidate compounds under development for treating unipolar depression and anxiety disorders. Both small molecule chemical compounds and nucleic acids (e.g., gene therapy drugs) are included.

In some embodiments, the antidepressant is a selective serotonin reuptake inhibitor (SSRI). Suitable examples of SSRIs include, but are not limited to, Citalopram (Cellexa®), Escitalopram (Lexapro®, Cipralex®), Paroxetine (Paxil®, Seroxat®), Fluoxetine (Prozac®), Fluvoxamine (Luvox®), and Sertraline (Zoloft®, Lustral®).

In some embodiments, the antidepressant is a serotonin-norepinephrine reuptake inhibitor (SNRI). Suitable examples of SNRIs include, but are not limited to, Desvenlafaxine (Pristiq®), Duloxetine (Cymbalta®), Levomilnacipran (Fetzima®), Milnacipran (Ixel®, Savella®), Tofenacen (Elamol®, Tofacine®), and Venlafaxine (Effexor®).

In some embodiments, the antidepressant is a norepinephrine reuptake inhibitor (NRI). Suitable examples of NRIs include, but are not limited to, Reboxetine (Edronax®), Viloxazine (Vivalan®), and Atomoxetine (Strattera).

In some embodiments, the antidepressant is lithium.

In some embodiments, the antidepressant is a serotonin modulator and stimulator (SMS). Suitable examples of SMSs include, but are not limited to, Vilazodone (Viibryd®) and Vortioxetine (Trintellix®).

In some embodiments, the antidepressant is a serotonin antagonist and reuptake inhibitor (SARI). Suitable examples of SARIs include, but are not limited to, Etoperidone (Axiomin®, Etonin®), Nefazodone (Nefadar®, Serzone®), and Trazodone (Desyrel®).

In some embodiments, the antidepressant is a tricyclic antidepressant (TCA), Suitable examples of TCAs include, but are not limited to, Amitriptyline (Elavil®, Endep®), Amitriptylinoxide (Amioxid®, Ambivalon®, Equilibrin®), Clomipramine (Anafranil®), Desipramine (Norpramin®, Pertofrane®), Dibenzepin (Noveril®, Victoril®), Dimetacrine (Istonil®), Dosulepin (Prothiaden®), Doxepin (Adapin®, Sinequan®), Imipramine (Tofranil®), Lofepramine (Lomont®, Gamanil®), Melitracen (Dixeran®, Melixeran®, Trausabun®), Nitroxazepine (Sintamil®), Nortriptyline (Pamelor®, Aventyl®), Noxiptiline (Agedal®, Elronon®, Nogedal®), Pipofezine (Azafen®/Azaphen®), Protriptyline (Vivactil®), and Trimipramine (Surmontil®). Also included are Butriptyline (Evadyne®), demexiptiline (Deparon®, Tinoran®), Imipraminoxide (Imiprex®, Elepsin®), iprindole (Prondol®, Galatur®, Tetran®), metapramine (Timaxel®), propizepine (Depressin®, Vagran®), and quinupramine (Kinuptil®, Kevopril®). Also included are Opipramol (Insidon®) and Tianeptine (Stablon®).

In some embodiments, the antidepressant is a tetracyclic antidepressants (TeCA). Suitable examples of TeCAs include, but are not limited to, Amoxapine (Asendin®), Maprotiline (Ludiomil®), Mianserin (Bolvidon®, Norval®, Tolvon®), Mirtazapine (Remeron®), and Setiptiline (Tecipul®).

In some embodiments, the antidepressant is a monoamine oxidase inhibitors (MAOI). Suitable examples of MAOIs include, but are not limited to, Iproniazid (Marsilid®), Isocarboxazid (Marplan®), Phenelzine (Nardil®), Selegiline (Eldepryl®, Zelapar®, Emsam®), Tranylcypromine (Parnate®), Metralindole (Inkazan®), Moclobemide (Aurorix®, Manerix®), Pirlindole (Pirazidol®), and Toloxatone (Humoryl®). Others include, for example, benmoxin (Neuralex®), Caroxazone (Surodil®, Timostenil®), iproclozide (Sursum®), mebanazine) (Actomol®), nialamide (Niamid®), octamoxin (Ximaol®), pheniprazine (Catron®), phenoxypropazine (Drazine®), pivhydrazine (Tersavid®), safrazine (Safra®), Eprobemide (Befol®), and minaprine (Brantur®, Cantor®).

In some embodiments, the antidepressant is an atypical antipsychotic. Suitable examples of atypical antipsychotic include, but are not limited to, Amisulpride (Solian®), Lurasidone (Latuda®), and Quetiapine (Seroquel®).

In some embodiments, the antidepressant is Agomelatine (Valdoxan®), Bifemelane (Alnert®, Celeport®), Bupropion (Wellbutrin®), Ketamine (Ketalar®), Tandospirone (Sediel®), or Teniloxazine (Lucelan®, Metatone®).

In some embodiments, the anxiolytic agent is a benzodiazepine, including but not limited to, Alprazolam (Xanax®), Bromazepam (Lectopam®, Lexotan®), Chlordiazepoxide (Librium®), Clonazepam (Klonopin®, Rivotril®), Clorazepate (Tranxene®), Diazepam (Valium®), Flurazepam (Dalmane®), Lorazepam (Ativan®), Oxazepam (Serax®, Serapax®), Temazepam (Restoril®), Triazolam (Halcion®), and Tofisopam (Emandaxin®, Grandaxin®).

In some embodiments, the anxiolytic agent is a carbamate, including but not limited to, meprobamate (Miltown®, Equanil®).

In some embodiments, the anxiolytic agent is an antihistamine, including but not limited to, Hydroxyzine (Atarax®), Chlorpheniramine (Chlor-Trimeton®), and diphenhydramine (Benadryl®).

In some embodiments, the anxiolytic agent is an azapirone, including but not limited to, Buspirone (Buspar®) and Tandospirone (Sediel®).

In some embodiments, the anxiolytic agent is an SSRI, SNRI, TCA, TeCA, or MAOI, as described herein.

In some embodiments, the anxiolytic agent is Mebicar (Mebicarum®), Fabomotizole (Afobazole®), Selank, Bromantane, Emoxypine, Pregabalin, Menthyl isovalerate, or Menthyl isovalerate (Validol®).

Administration of the antidepressant or anxiolytic agents to a rodent can be by any suitable route including, but not limited to, parenteral, intravenous, oral, subcutaneous, intraarterial, intracranial, intrathecal, intraperitoneal, topical, intranasal, or intramuscular. Administration may also be by continuous infusion, local administration, sustained release from implants (gels, membranes or the like), and/or intravenous injection.

The agents can be given to a rodent for a period of time appropriate, for example, 3, 4, 5, 6, 7, 8, 9, or 10 weeks, or longer if needed.

The present description is further illustrated by the following examples, which should not be construed as limiting in any way. The contents of all cited references (including literature references, issued patents, and published patent applications as cited throughout this application) are hereby expressly incorporated by reference.

EXAMPLES

Example 1

Generation of Genetically Modified Mice

Gpr156 targeting constructs were designed as follows. For knockout of mouse Gpr156, a bacterial artificial chromosome (BAC) containing mouse Gpr156 genomic sequence was modified such that a foxed lacZ reporter cassette containing a neomycin resistance gene under the control of the human UBC (ubiquitin) promoter replaced Gpr156 exon 2. (or coding exon 1, i.e., the first coding exon) just after the start ATG codon to the end of exon 5 (or coding exon 4). The cassette was cloned such that the lacZ coding sequence was in frame with the start ATG codon. This construct was electroporated into 100% C57Bl/6NTac mouse embryonic stem cells. To humanize the Gpr156 locus, the mouse ATG to stop genomic sequence was replaced with human GPR156 ATG to 100 bp beyond the end of the 3' untranslated region. This human GPR156 DNA encodes the long isoform (814 amino acids) with Glu (E) at position 516. A self-deleting neomycin resistance cassette was placed just after the humanization, at the 3' end of the Gpr156 locus. This targeting construct was then further modified by adding a single A to T base pair substitution in human GPR156 coding exon 9 to generate the E533D human mutation and a puromycin resistance cassette replaced the neomycin version. These constructs were electroporated into a 50% C57Bl/6NTac/50% 129SvEvTac mouse embryonic stem cell line. Successfully targeted clones from all electroporations were identified by TAQMAN analysis. $Gpr156^{-/-}$, $Gpr156^{humIn/+}$, and $Gpr156^{humIn\ G533D/+}$ mice were generated using the VelociGene© method (Valenzuela 2003 Nat Biotech PMID:12730667; Poueymirou 2007 Nat Biotech PMID:17187059) and backcrossed to C57Bl/6NTac as needed.

Example 2

Assessing Expression of Gpr156 Through a Reporter

Using genetically modified mice which comprise a deletion in an endogenous mouse Gpr156 gene and an insertion of a reporter gene, wherein the reporter gene is operably linked to the endogenous mouse Gpr156 promoter at the endogenous mouse Gpr156 locus, the inventors were able to confirm expression of Gpr156 in the brain of adult mice with significant expression in olfactory bulb, hippocampus, habenula, fasciculus retroflexus, and the colliculus. These regions of the brain have been associated with depression and anxiety in humans and animal models of depression. The strongest expression was detected in the habenula; medial and lateral habenula show reduced volume in patients having a depressive disorder. Functional imaging studies in humans highlighted the lateral habenula as selectively activated by negative outcomes (Shepard et al., Schiz Bull. 32:417-421 (2006), Ullsperger and von Cramon, J Neurosci. 23:4308-4314 (2003)). In addition, accumulating evidence in rodents and humans demonstrate that the lateral habenula is hyperactive in several models of major depression, with increased activity linked to exposure to different kinds of stressors (Li et al., Nature 470:535-539 (2011), Mirrione et al, Front. Hum. Neurosci. 8:29 (2014), Morris et al, NemoImage 10:163-172 (1999), Shumake et al., Brain Res, 963:274-281 (2003), Wirtshafter et al., Brain Res. 633:21-26 (1994)). The habenula has also been successfully tested as a novel target for deep brain stimulation in the treatment of depression (Sartorius et al., Biol. Psychiatry 67:e9-e11 (2010)).

Example 3

Methods Used to Assess Genetically Modified Rodents

Animals

All procedures were conducted in compliance with protocols approved by Regeneron Pharmaceuticals Institutional Animal Care and Use Committee (IACUC). All mice are housed on 12 hours on off light cycle (7 am to 7 pm) with free access to water and food.

Marble Burying Task

Marble burying task is used as an indicator of obsessive compulsive-like behavior and/or anxiety-like behavior. When mice are placed in a novel cage, a common response is an increase in digging behavior. This test is used to evaluate the effect of drugs on the mice's natural and repetitive behavior of burying marbles, which is reduced by drugs with anti-compulsive property (Njung'e and Handley, Br J Pharmacol. 104:105-112 (1991b), Thomas et al., Psychopharmacol. 204:361-373 (2009)).

Tecniplast Mouse Cages (39×19×16 cm) were evenly filled with 5 cm of corn cob bedding. 24 clear glass marbles (15 cm diameter) were evenly spaced on top of the bedding in a 4×6 grid pattern. Each mouse was placed at the center of the cage and the test was run for 10 minutes. After 10 min, the animals were removed from cages and the number of marbles at least two-thirds buried was counted.

Forced Swim Test

Mice were placed in a 5 liter clear plastic beaker (25×18 cm diameter) filled with 4 liters of 23-25° C. tap water to ensure mice cannot touch the bottom of the flask even with their tail. Four animals were recorded simultaneously using an ANY-maze™ video-tracking system (Stoelting Co.). Data were recorded for 6 minutes. Flask were separated by 3 sided white plastic partitions (40 cm high×25 cm wide). Swim test was recorded for 6 minutes. Recordings were set up to start automatically if there was motion in the flask so that recorded times are specific for each individual mouse. If a mouse was unable to perform the test, it was pulled out of the water as soon as it showed signs of distress.

The 6 minutes recording was broken into three time segments (0-100 seconds, 101-200 second and last 158 seconds) to get a better sampling of behaviors across time.

Main data points analyzed for the FST were swim time, time mobile, time immobile, speed, distance traveled, rearing in the swim zone, mobile episodes and immobile episodes. Immobility is defined as 60% of total body mass being immobile for 2 seconds. This parameter allows for small movements of hind legs and feet to maintain balance and or to tread water without be considered actively swimming.

Balance Beam

The balance beam (Maze Engineers) was used to assess coordination and sensorineural balance. Mice were trained to walk on a one meter long, 6 mm wide beam with an open platform at one end at its beginning and an open sided black box as a finish point. The beam was elevated above a cloth hammock to catch any mouse that slips off the beam. During the training session, mice were first placed right next to the end box and then placed progressively further away from it until the mouse could walk the beam. Then three subsequent 1-minute trials were run with a break of 30 second between runs. The mouse was place in front of the open platform facing finish point and is scored for number of slips and time taken to reach the finish point.

Rotarod Test

Motor coordination and balance were evaluated by an accelerating Rotarod from IITC Life Science series 8. Mice were placed on a horizontally oriented, rotating cylinder suspended above a cage floor for 3 minutes. The rotating cylinder was low enough not to injure the animal but high enough to induce avoidance of fall. The length of time that a given animal stays on this rotating rod is a measure of their balance, coordination, physical condition, and motor-planning. Animals were first trained to stay on a rotarod (3.5 cm diameter, 9 cm wide) rotating at progressively higher speeds (maximum speed 15 rpm, 3 trials). The next day, each mouse was placed on the rotarod at up to 15 rpm for 3 consecutive trials (30 minutes between trials) for 180 seconds per trial. The latency to fall off was recorded or a score of up to 180 was assigned if the animals did not fall off. The median score of 3 trials for each mouse was used in analysis.

Catwalk

To evaluate footfall and gait changes, mice were evaluated using the CatWalk™ XT (Noldus) video based automated free-walking gait analysis system which allows for quantitative assessment of up to 35 gait parameters (from footprint size to locomotion dynamics). This system allows for the animals to voluntarily move at preferred speeds in a similar fashion to clinical gait testing in humans. Animals were placed at the beginning of the runway, with the open end in front of them. Mice spontaneously run to the end of the runway to attempt to escape. Each mouse was evaluated until it had three successful catwalk runs and mice must travel the recording area of the walkway within 5 seconds for the run to be counted. The device consisted of a 130 cm long hardened glass platform with an adjustable alleyway to limit movements to straight lines, a red overhead light, a green LED light attached to the glass platform, and a high-speed color camera mounted below the platform. The green LED light attached to the apparatus emitted light into the glass plate, and this light was only refracted wherever rodent paws contacted the glass, allowing the high speed digital camera to capture precise rodent paw placement in real time. The overhead red light created contrast for recording of the body outline. The visual data was digitized and transferred to an attached computer where the CatWalk™ XT software could be used for semi-automated labeling and analysis of static and dynamic gait kinematics via distance, time, and intensity differences between paw prints. Gait data was then exported for data storage and subsequent analyses.

The camera recorded, and the software of the system measured the footprints. The footprints were analyzed for abnormalities in paw placement.

Open Field

The open field is an empty relatively large, brightly lit rectangular shape arena, in which the animal's activity is measured. The assessment reflects novel environment exploration, general locomotor activity, and can provide an initial screen for anxiety-related behavior in rodents. Mice were placed in the open field apparatus (Kinder scientific; 16"W×16"L×15"H chamber) and scored for 60 minutes. The chamber was set up as two zones; a center zone grid (6"×6") and an outer zone grid (16"×16") and animal movements are collected by 32 infra-red photobeams. A decrease in exploratory behavior into the center zone has been associated with an anxiety phenotype. The amount of times a mouse crosses a grid line (i.e. move from one grid to another) was counted, as well as number of times rearing, time spent immobile, and number of grooming events. In the Kinder Scientific apparatus, these events were automatically counted via computer software and infrared beams around the open field.

Tail Twist

The tail twist is a simple method that can be used to screen for possible vestibular dysfunction. The mouse was placed onto a flat surface and grasping the mouse mid-tail twist the tails so that the mouse was turned onto it's back. If the animal had difficulties righting itself back onto its feet, this could indicate a vestibular deficit.

Righting Reflex

Righting Reflex is a simple assay to assess motor coordination and vestibular dysfunction. Mice were placed on their back on a flat surface. The time taken to right itself (up to a maximum of 30 sec) was measured.

Wire Hanging Test

Wire hanging is an alternate test to measure grip strength of either the hind paws or fore paws. Slipping of the feet, or inability to hang can indicate a deficit. A wire cage top suspended at least 12 inches from table top with blue pad was used. Mice were allowed to grip the wire cage top with either their hind paws or fore paws, and the total time mice held onto the bar was measured during a 60 second interval. Three 60 second intervals per mouse was measured. Latency to fall was recorded.

Example 3

Assessing Mice in Various Behavioral Assays

Forced Swim Test

Figure 2:
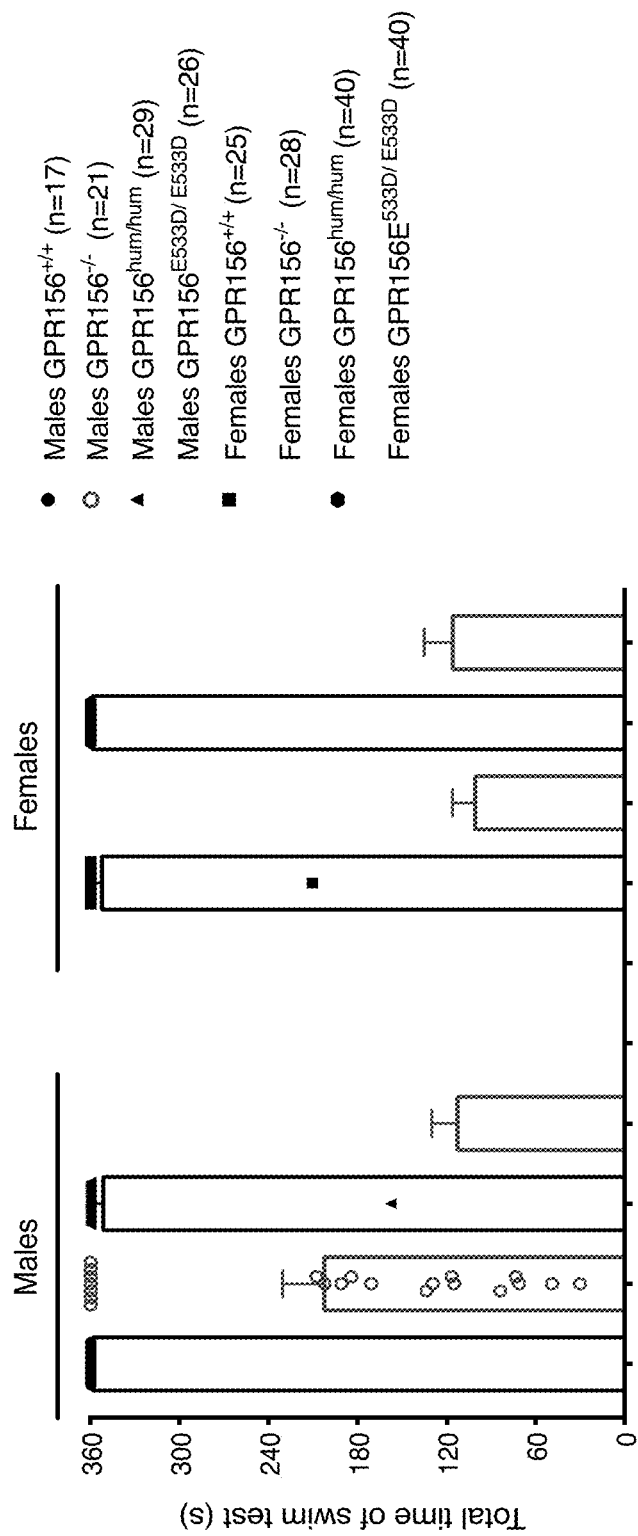
FIG. 2. Total time of swim test (in seconds). Mice were tested for a 6 minute forced swim test; not all mice were able to perform the task. The graph shows the duration of the swim test for different Gpr156 genotypes tested, from left to right, male Gpr156$^{+/+}$, male Gpr156$^{-/-}$, male GPR156$^{hum/hum}$ (homozygous for wild type human GPR156), male GPR156$^{E533D/E533D}$, female Gpr156$^{+/+}$, female Gpr156$^{-/-}$, female GPR156$^{hum/hum}$, and female GPR156$^{E533D/E533D}$. Data are expressed as mean±SEM for each animal group.

Mice were assessed in a 6 minute forced swim test; not all mice were able to perform the task. FIG. 2 shows the duration of the swim test for different GPR156/Gpr156 genotypes tested. Data are expressed as mean±SEM for each animal group.

The data show that genetically modified mice homozygous for the humanized Gpr156 gene encoding an E533D variation and genetically modified mice homozygous for the deletion of the mouse Gpr156 gene exhibited an inability to perform a forced swim test. The mice were initially able to swim but after a couple of minutes of trying to find an escape, it appeared as if mice "panicked" in the water. These mice then started to display an abnormal behavior characterized by frenetic swimming, repetitive diving and spinning under water and become unable to stay afloat. If not quickly retrieved out of the water, these mice drown. In contrast, a wild type mouse (expressing endogenous mouse Gpr156) and a genetically modified mouse homozygous for the humanized Gpr156 gene (without the mutation) had no difficulty completing the 6 minutes swim test.

The peculiar behavior displayed by genetically modified mice homozygous for the humanized Gpr156 gene encoding an E533D variation or genetically modified mice homozygous for the deletion of the mouse Gpr156 gene has not been described by others in the literature. Due to the fact that these mice are unable to complete the test, the inventors were not able to measure learned helplessness. However, the inventors observed that 85% of female and 90% of male genetically modified mice that are homozygous for the humanized Gpr156 gene encoding an E533D variation failed the training swim session while genetically modified rodent, homozygous for a humanized Gpr156 gene encoding a wild type human GPR156 protein easily completed the test. Similarly, 90% of female and 53% of male genetically modified mice homozygous for a deletion of the mouse Gpr156 gene failed the training swim session while their wild-type littermates completed the test. Similar results were obtained when the swim test training session was run in water heated at 30° C. instead of room temperature 23° C.) or when using a water maze apparatus which is bigger and presents with a platform (escape option). The observations from the forced swim test suggest that the E533D point mutation leads to a deficit or a loss in the function of the GPR156 protein.

Mice were also assessed for their coordination, balance and motor functions, their general locomotion activity, and their vestibular functions in rotarod, catwalk, balance beam, open field, righting reflex, tail hanging reflex and wire hanging tests. Genetically modified mice homozygous for the humanized Gpr156 gene encoding an E533D variation or wild type humanized Gpr156 gene did not exhibit any gross deficits in balance, and coordination or motor deficits and/or vestibular dysfunction, as summarized in Table 2 below.

Figure 3A:
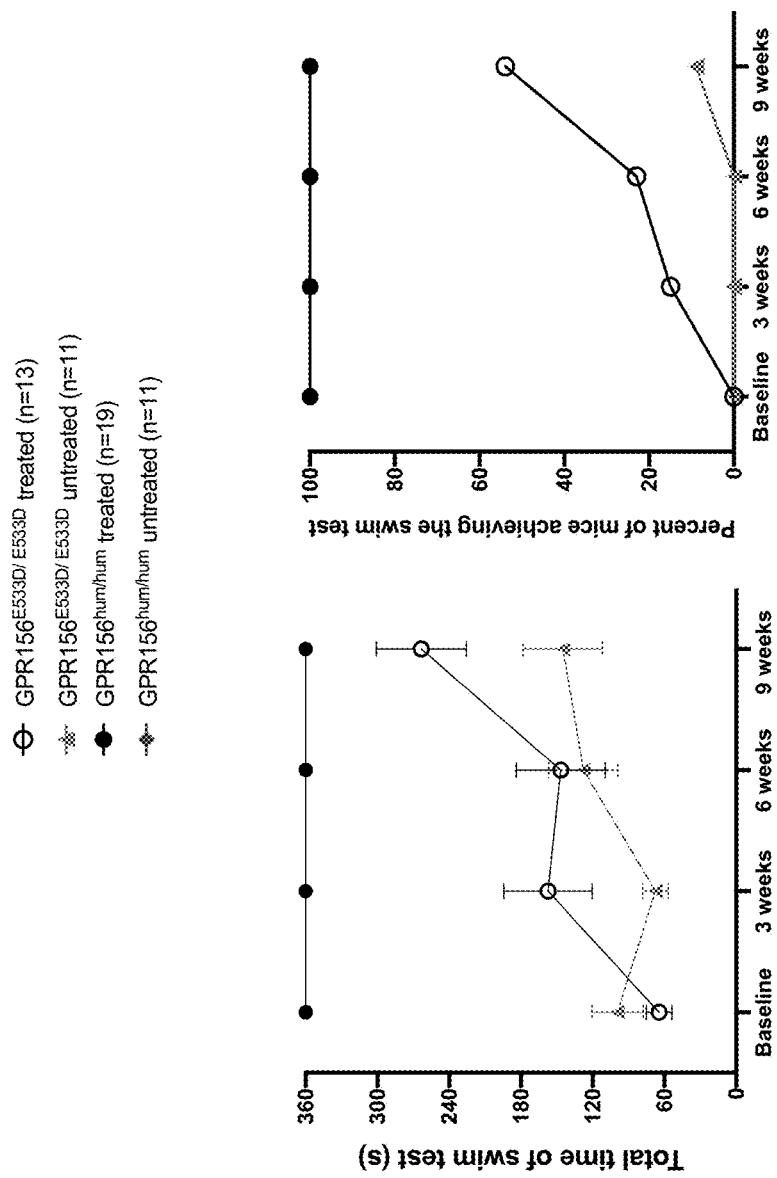
FIG. 3A. Left panel: Total time of swim test (in seconds) before and after daily treatment with intraperitoneal injection of Fluoxetine 10 mg/kg for 9 weeks (6 days per week daily injection). Mice were tested for a 6 minute forced swim every 3 weeks. The graph shows the average±SEM duration of the swim test for different Gpr156 genotypes tested: treated GPR156$^{E533D/E533D}$ mice, treated male GPR156$^{hum/hum}$, treated female GPR156$^{E533D/E533D}$, treated female GPR156$^{hum/hum}$ and untreated female GPR156$^{E533D/E533D}$. Treatment with Fluoxetine improves the impaired swim phenotype in GPR156$^{E533D/E533D}$ mice. Right panel: Percentage of mice achieving the swim test for different GPR156 genotypes tested at 3 weeks, 6 weeks and 9 weeks after intraperitoneal injection of Fluoxetine. While none (0/13) of the GPR156$^{E533D/E533D}$ mice were able to perform the swim test the first time, following a 9 weeks treatment with Fluoxetine, 53% (7/13) of the GPR156$^{E533D/E533D}$ mice achieved the test (with an 8th mouse failing the test at 350 seconds).

To investigate whether the inability to perform the swim test could be a feature of anxiety, mice were treated with intraperitoneal injection of Fluoxetine, a selective Serotonin Reuptake Inhibitor (SSRI, 10 mg/kg), daily for 4 weeks. Mice were tested for a 6 minute forced swim test weekly before and after daily treatment with intraperitoneal injection of Fluoxetine 10 mg/kg for 4 weeks. Total time of swim test seconds) before and after daily treatment with Fluoxetine was recorded. As shown in FIG. 3A, in the initial forced swim test (baseline, before treatment), none of the mice homozygous for the humanized Gpr156 gene encoding an E533D variation tested were able to perform the 6 minutes swim test. After 4 weeks of treatment with fluoxetine, 62.5% of males (5 out of 8 mice) and 50% of female (5 out of 10) were able to successfully perform the 6 minutes swim test. A group of untreated females GPR156$^{E533D}$ was also run in parallel as control, after 4 weeks only 20% (1 out of 5) females achieved the swim test. Data were expressed as mean±SEM for each animal group.

Figure 3B:
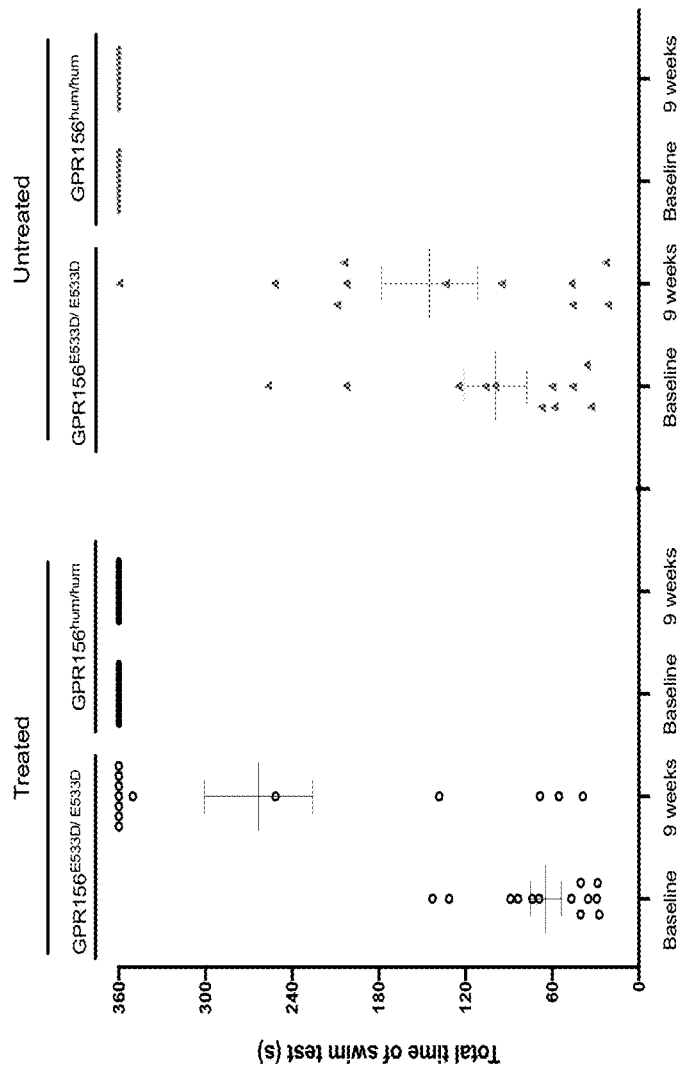
FIG. 3B. Performances in swim test plotted over the 9 weeks from individual GPR156$^{E533D/E533D}$ mice studied in the experiments in FIG. 3A, showing that treatment with Fluoxetine improves the impaired swim phenotype in the GPR156$^{E533D/E533D}$ mice. Following a 9 weeks treatment with Fluoxetine, 53% of the mice achieved the test. On the other hand, in the untreated group, while some mice improved their performance, only 1/11 mice achieved the swim test at 9 weeks.
Figure 3C:
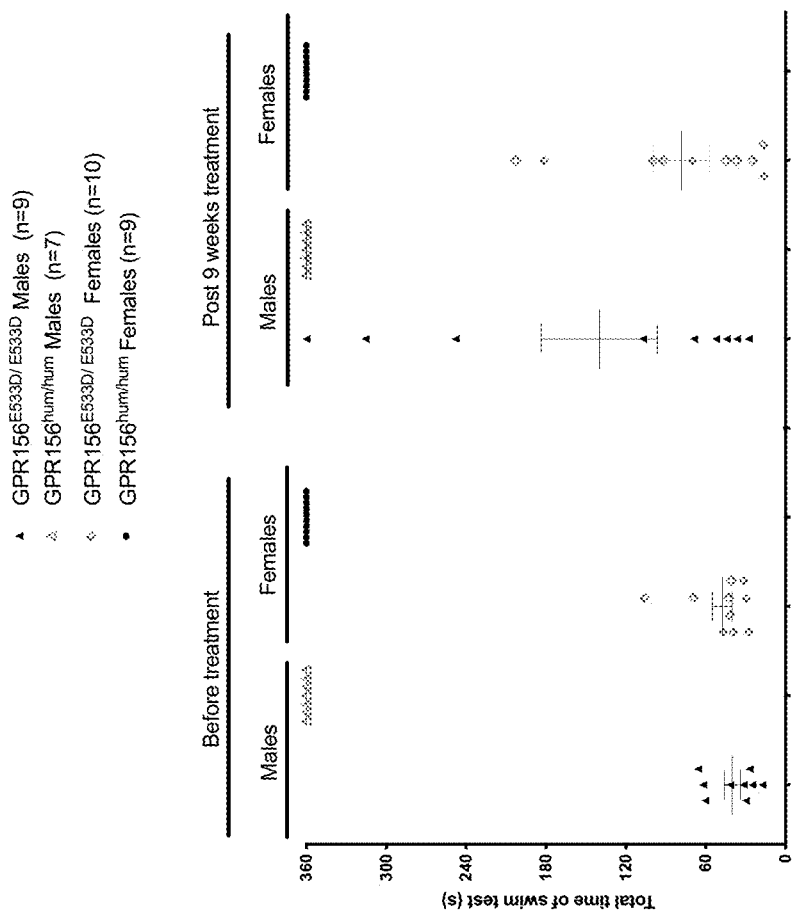
FIGS. 3C-3D. Treatment with imipramine improves the impaired swim phenotype in GPR156$^{E533D/E553D}$ mice.

To test whether Fluoxetine could reverse the impaired swim test phenotype, GPR156$^{hum/hum}$ and GPR156$^{E533D/E533D}$ mice were treated with Fluoxetine 10 mg/kg (i.p) daily for 6 days/week for 9 weeks. Similar to GPR156$^{-/-}$ mice, GPR156$^{E533D/E533D}$ mice showed an impairment in the swim test with about 85% of female and 90% of male failing to complete a 6 minutes swim test. Therefore, mice were subjected to a swim test (baseline) and animals able to perform the 6 minutes swim test were excluded from the study. The remaining mice were then split into 2 groups, treated and untreated with Fluoxetine. As shown in FIG. 3B, while none (0/13) of the GPR156$^{E533D}$ mice were able to perform the swim test the first time, following a 9 weeks treatment with Fluoxetine, 61% (8/13) of the mice achieved the test. In contrast, in the untreated group, while some mice improved their performance, only 1/11 mice achieved the swim test at 9 weeks (see FIG. 3C; see also FIG. 3B).

Figure 3D:
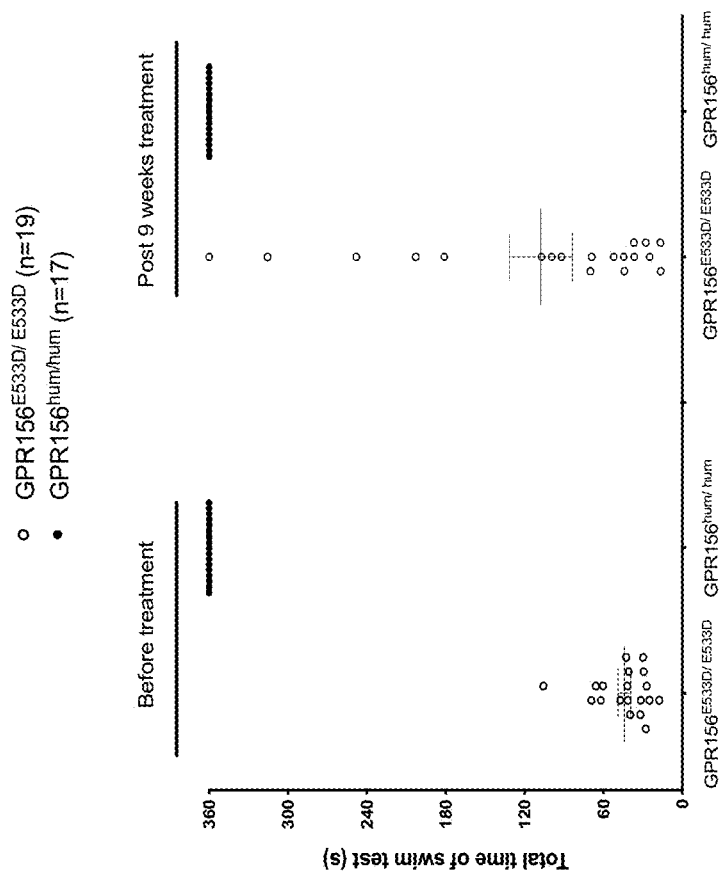

Treatment with another antidepressant drug, imipramine (Tofranil), also improves the impaird swim phenotype in GPR156$^{E533D/E533D}$. Imipramine is a tricyclic antidepressant that inhibits reuptake of norepinephrine, acetylcholine, dopamine and serotonin. For this study, mice were subjected to a swim test (baseline) and animals able to perform the 6 minutes swim test were excluded from the study. Mice were treated with imipramine 15 mg/kg (i.p) daily for 6 days/week for 9 weeks. As shown in FIG. 3D, treatment with imipramine also induced an improvement in the performance of the GPR156$^{E533D/E533D}$ mice to complete the swim test.

Mice were additionally assessed in a marble burying test. As shown in FIG. 4, genetically modified male mice homozygous for the humanized Gpr156 gene encoding an E533D variation or homozygous for the deletion of the mouse Gpr156 gene exhibited a trend toward an increase in the number of marbles buried in 10 minutes. Data are expressed as mean±SEM for each animal group.

TABLE 2

| Phenotype | Behavioral assay | GPR156$^{-/-}$ | GPR156 humanized | GPR156E533D |
|---|---|---|---|---|
| Depression | Forced swim test | 90% of female and 67% of males failed the training swim session (not a known depression phenotype) | Similar to wildtype, all animals achieved the swim test | 85% of female and 90% of males failed the training swim session<br>Following 4-9 weeks of treatment with Fluoxetine (10 mg/kg, i.p., daily), 53% (7/13) of GPR156$^{E533D/E533D}$ mice achieved the test while none of the mice were able to perform the swim test prior to treatment, |
| Coordination, balance and motor deficits | Rotarod | No significant difference | No significant difference | Overall all mice completed the task but some males GPR156$^{E533D+/+}$ fell off in 1 of the 3 consecutive trials |
|  | Catwalk | No significant difference | No significant difference | No significant difference |
|  | Balance beam | No significant difference | No significant difference | No significant difference |
| Activity, general locomotion | Open field | Slight increase in immobility and decrease in ambulation<br>Slight decrease in number of rears and rearing time compared to wild type mice littermates | No significant difference | No significant difference |
| Vestibular dysfunction | Righting reflex<br>Tail hanging reflex<br>Wire hanging | No significant difference | No significant difference | No significant difference |
| Anxiety | Marble burying | Males and females GPR156$^{-/-}$ may show increased number of marbles buried in 10 min | No significant difference | Males GPR156$^{E533D+/+}$ may show increased number of marbles buried in 10 min |

SEQUENCE LISTING (28 sequences)

SEQ ID NO: 1 - protein, 814 aa, Homo sapien
  Wild type GPR156 long isoform protein E516 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 2 - protein, 814 aa, Homo sapien
  Wild type GPR156 long isoform protein D516 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPDRGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 3 - protein, 810 aa, Homo sapien
  Wild type GPR156 short isoform protein E512 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 4 - protein, 810 aa, Homo sapien [sequence omitted]

SEQ ID NO: 5 - protein, 814 aa, Homo sapien
  Mutant (E533D) full length  GPR156 protein E516 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 6 - protein, 814 aa, Homo sapien
  Mutant (E533D) full length GPR156 protein D516 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPDRGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 7 - protein, 810 aa, Homo sapien
  Mutant (E529D) GPR156 short isoform protein E512 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 8 - protein, 810 aa, Homo sapien
  Mutant (E529D) GPR156 short isoform protein D512 variant
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPDRGGSDPQRQRHLENSEDPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 9 - DNA, 120450 bp, Homo sapien
  Wild type full length GPR156 genomic DNA (E516 variant)
  variation (117166) .. (117166): n is a or g
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtcagtatgacggtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 10 - DNA, 120450 bp, Homo sapien; identical to SEQ ID NO: 9
  Wild type full length GPR156 genomic DNA (D516 variant)
  variation (117166) .. (117166): n is c or t

SEQ ID NO: 11 - DNA, 120438 bp, Homo sapien
  Wild type GPR156 short isoform genomic DNA (E512 variant)
  variation (117154) .. (117154): n is a or g
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 12 - DNA, 120438 bp, Homo sapien; identical to SEQ ID NO: 11
  Wild type GPR156 short isoform genomic DNA (D512 variant)
  variation (117154) .. (117154): n is c or t

SEQ ID NO: 13 - DNA, 120450 bp, Homo sapien
  Mutant (E533D) full length GPR156 genomic DNA (E516 variant)
  variation (117166) .. (117166): n is a or g
  variation (117217) .. (117217): n is c or t
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtcagtatgacggtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggancccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 14 - DNA, 120450 bp, Homo sapien; identical to SEQ ID NO: 13
  Mutant (E533D) full length GPR156 genomic DNA (D516 variant)
  variation (117166) .. (117166): n is c or t
  variation (117217) .. (117217): n is c or t

SEQ ID NO: 15 - DNA, 120438 bp, Homo sapien
  Mutant (E529D) GPR156 short isome genomic DNA (E512 variant)
  variation (117154) .. (117154): n is a or g
  variation (117205) .. (117205): n is c or t
ggggaccgtgggcgtcctgcacatagcagcgggcttggcgcttctcggcggtccgacgctgatgaggtgagcacagcgaccttaaggatccacaaaacttcaaacacttaattattaagtgaaagtggaaagggggaggggctttctctccctttccagaatctgggcagtttgtttggaaccggtaaagaaactctcataggaacttgaggtgagcaggggtcacgcatcagggatgcgagtggcaatttcagtggaagagacgggagagtactgtaatttggtgtgaagatggggccgtgggttttctgctgaataagcgaccggctgtgctgaaaatgagagatcccgaaacagtttcccaccgcctgtagactttccagagtctcctcacgccgaatctgctttgcagggcatgttcacccccagggtgtagagtggcgggcacgatgggctcccccatggagattgcaaagtcctgaaaagggacaattgtattgcactgcgtctgttgaactgccttgcttctgggcatgagggagtcacctggaagctgcaacatccttgtaccctggcaagcagccctttccaagttagctctgtcagaaactagaggcctctaggtagaactcaaggtatccatgtactcgtgaagaatacaaaccttgaggtttttaaaatcgaattttgttaagatttcaggatagaaatctgggaagagaagtcatggcatggcataacttacccctttgttagttttctaggtacatgcatgcttgaattagaggtaaatgatgccctagcctatcataaaatgtctttcctggtgtagttctttaaaccagaatatggaggataacattacatttttgcatcctagataaaagggaaagattttcagatggggcttacacagcgggagaaattgttgatatagttgtattaggcagcaaggcctgcaaagaaaaacttctttttctccaccagtggctgaattctgcacagaatgtctcctcgcagtctgggtagcagcccggcttgcaaaaacagtgcttctttcattgctgcaggtggggcaaatgcgcttgcggataaatggctggggaagcgtttgcttacaggttaaggcaatttgagtctggagaataaagtgctttagcaggctgtgcttgagttaggtgtcccttgtgaggaatagaggtggctttctggtccccattttgccagcctaattccccttcagggacactactgtctctggaatgttccctctgtttccccttctcttccacccccagcttttagcttctccccattccccagtaaagtctagaattgagcctggtcagagtcaaagttctgatagcctagggatatagaacttcaagcctggtgaaggcagaaatgagacctaggagagacccaagatgggtgagatgaaacaactttcagcctagaaggctctcaaaagagtggaaaaataatgattgagggaaacagattctctggaaaggagaataggtgcttaagtgtttgttttcagctgagggttttaatatttccatttttgttgtttaaccataagggaatttccattatagggtaggaggaggatgaggccttctctgaaaactgcatccttctccttgaatttgcattttattccattcttatgtaggtttcagagattaattgggggaagggggagagaggaaagaagccagaggctctgacatgctgcagaaacagtgcaacgtggactgacttgggctgcaaaggtggatttgggggttgaaagaaatgttctacatttagttgaaaaaaaaaaatcagagcctttattttgcaaaggtcttgagaatcagaacattcatgtttagttgctgatgaattttgcctgataaaggatgcaaatcactatctcacctttttttctccagtactttattatgaaaaattttagacatacagagatgttttctacctctcattttataaacttattatcttaaaacaaacttgttaataaaaatcagtgtttagaatccagacatatgtgatctggtcctggacagagcttgaatcagaaggtgtttcaaatatagatgtgtgaaggatattaacattttaagaaaaaaatatggatcttattcttctgactttcccataagaatcttgagcagaccccttaactgccttctttttcccattcttaaaatgtcagtcagttggatgatattactctcctgcttaacaccctccaatggcttcccctcacactgtgaataacattcaactctccaccagggcttgtgatttggtctggtgccctcatattctatggccgtcctcttgcttaccatcgtccttgctcttccctctgcctgaacactcttccttcagacactgccactgcttcttttctcagctcattccagtttcttttcatactctccagaatgatggccacctgatctaaaacagcctgtggtcactccctgtcttctgaccctgctttatccttcttcatggcacttagcactccctgacactatatagtatatgtgtttccttgttaattgggcatgttccccactctaatgtaaactccatcaagacaaggaatttttttgtcttatttatggctgtgttcctatttggtatattatgagcaattaataaataactgttggattaattaggtaactaaattacacaaataaggcattgactcccataagggtggcagaacccttggtaaaatactagaagtcctttgaggtaattcataattcaagttaatcaatatttgataggtaaatgatgaccctggagatcagtggcctcttttatcctcacagcacttctcagctgaatcctatgctaatagctggccagttttgacaaacccacatcccaaacaagacataaaatatttcagtcacagaacttttcctcacgtctctttctagtcacctccaccccacagaagcagcaaaccttgttctgatttctaatatcatagattagtgttgctggttcctgaatttcatataactgcagttacacagtatgcactcttgtgtttggcttctttttgccctacacaatgtctgtgatattcatctgtgccattgtgtgtatcagtagttcatttcttttttttccaaggtagtatttattgtatgaatattgaccatgtgtttatctgttctcttgttgatagatacttggttgttgccagtttgtggcaattttgaacaaagctgctgtgaacctataaagggtctgcctcatcttgagtcttctctactttatatgaaaatcttccttgtgccaccaatgcagagagaagtatggcaaggttatgggggctgtgactgatgtagcagcttgcatgtaccccagccagtgctctctctagacagctctgctgggagctgacctgcttcccactttagagggaaagcacttggaaaatgagtgtctaacaaattagcgagccctccagtgcactcttaagtgctttaaatccttgaaagagacactgtggaatgcctgctgccatcactgttgtatttccctcctcctctcagcttccccatcccagcacaagttgactctaatcagcttctgagcattatgctactgaggggtttaaacattcatgagcaagagtcttgttcagagcctgataaaatattcatgtgtttccatggggcattggtttccatctagacttctcaaggcatttttctgagatgcatgtcgtaattgtgaagaactcagacagtgatggatgatacggccctgtgttattaaaccctaccacacagagcaccttgctttctagggatggagaagaatgagcacacagaaaaattgacattaatcctgtctagatcaagagaaaggctacatgtactgataaaaatggcttgagtaaagaggggcctgttaatatagtaccaacaaaggtatgaatccatagaggagagtgaaaagaacttgttaaaatgagaggaatgctgggatgcagtcattccaagtggaagaatgggggaatcagcattgtaaaatgcacagttcctttgacactcatgtggacgaggttcatatgagacaactgtgctgagtgctgtaattatcacaacctgctatgagaggatgagagtagaagtggaggctaggcagggtttccaagtagagccagagagctattccaagaggagtcaacatttctcttcaaggaagaagtggctttgagtcaggttctgaaggaggtgtgcctctttgactggcagctgcggtgtggaagggactttccagagagacagaatagcatgatagagtgagggccaaagtgccggtgtggtgtgagtaaggagagaaggtgggtggatgggggtcagggcagggttgcagcaagacataaagcaggagagctaaaggccagcttatgaaggccacaggaggatggacttcagtctgtttgctggagggccgtgtaacttttggccagagattgggttacattttgaggagttcttgggaagtatatccaccctaggcaaggccttgaggtatgtttatgtccaaggcatttccagaatattctgctgtgtccagaacactatgaagactctacgtggtctactctaagagaggtaaaccagaggaggtcagatatactcagtatactcctgggactgaccagaaacaggcctcaccaggcacctctctgcccccagcacacaaacactcagaatattctgagtcagattgaatccacagcattccctagacttcttcatgaccactttgcctcagctgggggagttgcaatgatctaagtatccccttatcacctgaatctgggccaggatacctcagacatgggttgccaggcaactgagggctaagtgatgcagctggccaatcatccccacaaagcccaggtctgctttgaccaggccatcgggctgtgaccagagaggcaacttggggggttgaggtcatgcagactgatgacttgtggacacaactgccaggccccttccatatgtcttcttcctttgggttgcagatttctattcaaaaatgcctcaggatgttgattttttaacccataataaaaatagtgaagtagggaggagtgttaaacatgtcagtcatctataccttatgttgtcattgggaagaaataactgtggaaacaattgtcccgggaaagtcagtcttcagtcttgcagtgaggagctttgcatatgtggagattagctagaaagctctggagttctgatggtgagaagggatttcttgggtcaaggataggaaagggcaagggaggaccttcatgattctccccagggctttgctggttggaattgctcttctgctgccatgggtagcatggggtttcagtgactgaaaacacccaggaaagtatgctctgggtcttcatgttgccatctgcctacactggaatgtcagaccatcagtcagcactgccagctctccatcttgattttctaagagttattgagaaaaccttgaaagggaaggcagaagtgggtgtcttaactagggaaatgccaaggtcctaaaggtgtggtctaggttgaaggtgtggtaagggcctgaagtcattggtctggcagtacttcagaccaataaagtctttcttggctcttatctaaaatattcctgattttctgtgtgaggtggaatctctcaagtgctgcattaatcagtcttttggctgaacaggtaaatagggtgcatgcttaattgagtgccttttctttttttaaagtttcagcttttattttacattaagaggatacatgtgtaggattgttcatgggtaaattggacccaggcataagcacagtacccaataggtagtttttcaacccatgccccctccctcccttccccctgtagtagtctgcagtatctatctttcctgcgtttatgtccatgtgtgctcagtgtttagctcccacttataagtgagaacatgtggtattttgttttctgttcctgcattaattcacttaggataggcctccaactgcatccacgttgctgcaaaggacatgatttcattattttttatcctatggtgtttatgtagcacattttcttcatccagtacactgttgatgagtgcctaggttgattccacatctttgctattgtgaatagtgctgtgatgcacatatgcaagcatgtgtatttatggtggaatgatttatatttctttgaatatatacccagtaatgggattgctgggtcaaaggtagctctgtatttaagttttttgagaaatctccaaactgctttccacagtggttgtactaatttacattcccaccaacaatgtataaatgttcccttttcttcacagccttgccagcatctgttgttttttgactttttaataatagctattcttactggtgtgagatggtatcttattgtggttttatttgcatttctctgatgattagtgatgctgagcatgttttcatgtctattggccacacttgtatgccttcttttaagaagtgtcttttcatgtcttctgcccactttttaatggagttatttgatttttgcctgttgatttaagtttcttatatattctggatattagacctttgtcagatgcatagtttgtgaatattttctcccatgctgtaggttgtttactcttttgatggtttctcttgctgtgcagaagatctttagtttaattaggtcccacttgtcaatttttgtttttgttgcagttctttctggggacttggccataaattctttgccaaggccaatgttgataagggtatttcctaggttttcttctatgatttttatagtttgaggtcttatgttaaatctttaatccatttttagttagtttttgtatatggtgaaaggtaagggtctagtttcattcttctgcatatggctaccagttatcccagcaccatttattgaatagggagtcctttctccattgcttgttttttgtcagccatgttgaagatcagatggttgtaagcgtgcagccttatttctgaattttctattatgttccattagtctatgtgtctctttttgtaccagtaccaccctgttttggctactctagcaaattctttggaattaaggaaaatagggacacaatttatgaagacctctgggatgtagccaaagcaatgttaagaggaaagtttatagccgtaaatgccttcatcaagaagctggaaagatctcacattaacaatgtaactttgcatttaaaggaactatgaaaaaaggacaaaccaaccccaactctagcagaagaaaagaaataactaaaattaaagaaaaacttaatgaaattgagatgcaacaatccatatgaaagatcagtgaaaccaagaataggctatttgaaaaaataaataagattgatagactgctagctaggttaacaaagcgggaggagacagtgagagagagagagaggatccaaataagtacaatagaaataacaaagatgacattacaactgatcctatagaaatacaaaagatccttggagaaaactatgaacagctctatgcacacaaattagaaaatctagaagaaatcaatcaattcctggaaacaatctcttgagattgaatcggagagattgaagtcctgaatagaccaacatcaaactctgaaattgcatcagtaaaacaaacaaacaaacaaaaaaaacccttccaaccataaaaagccctggaccagatagattcacagccacattctatgagacatgcaaagaagaactagtaccaatcctactaaaacttacagaaaatagaggagcagggactcctccccaattcatcccatgaagccagcatcagcctaatacccaaatctggcagagatatgatgaagagatatgatttttgtgtctatgttcagaccaatatccctgatgaacatagacacaaaaatcctcaacaaaatactagcaaaccaaatttagcagaacatcaaaaagttaattcaccatgatcaagcaggcattattcctgggatgcatggttggttcaacatacacaaatcatagtgagtcaccatgtaaacagaattaaaagcaaaaaccgttatgatcatctgtgtcatctcaatagacacagaaaaagcttttgataaaatctaacatctcttcatgataaaaactctcaacaaactaggcatcgaaggaacatacctcaaaataataagggccatccctgataaacctacagctaacatcatactgaatgggcaaaagctggaaccattccccttgagaactggaacaaggcaagaatgcccactctcaccactgctattcaaggtagtgctagaagtcccagccagcacagtctggcaatagaaagaaataaaaggcatccaaataagaaaagaagaagatgaactatctccctttgctgacgatataattctatacttagaacaccccaaagactgttccaaaaggttactagaattgaaaaatgattttagcaaggtttcaggatacaaaatcaatgtacgaaaatcagtagcatttctaaacaccaataacgtccaggctgagagtcaaatcaagaacatgatcccatttacgacagctgcaaagaaaaggaaatacctaggaatatagcaaaccaaaaaggtgaaagagctctgcaaggagaactacaatacactgctgaaaaaaagttagaaacaacacaaataaatgaaaaaatatcccatgctcatggattagaaggatcaatatcattaaaatggtcatactgcccaaagcaatgtatacattcaatgctattcctatcaaactactaacatcagtctttacagaattagaaaaaactattctaaaactcatatggaacccaaaaagagcctgaatagccaaagcaagcctgagcaaaaaaaaaaaaacaaagccggagcatcacactacctgagtgccttttctgaacagatatttcaatgattctgtgattattcatgagccagtgatggctgcctgcttttggatgctgctaggataaatgcagaagatcagagtgaagagggagagggaagcataacagcagcagagaggaaaagggaagagagtagtgacgtgctgaaatcgcagagattgtgggtacccagttatctacaagtgagaaacagggataaaagaagatcaaataactacccatgggaattttacatgcaaatattgctgacttccaaggcagctgtgaggagaaaggaagggaggagacacaaaggcagctgtcacagtcaatccgaggaatattaataaaaacttgacacatgaaaacacatggccgtatcacaacagcctgggtcccagcaaggatgtctattcaaacccctctttcacatttccttatattcattcacagtattaggtattttgcaagacattcatttgcacttgcaaagatacacaaatgcagagtacttaaaagggtaaactatcctaaaatattagtggtgagattataaatgattatttgtattttttcaacttatctatgttttccatgattgttttaagaagtgtgaatttctttgataatcagaaaaacattaaggagaaagggggttaagtagggaggtagagaaagaggcatggggtggggagagaggattgtagaaaagaaaaatatgttggaagatgaatgaacaattttaaaactttatgtttcacagactgctagcttgtgcatatttttctttattattgaatatatatgtttatcaccctcagaagatctggaagtaccaattggcatgaaactgaattgcaaatactgagctaagtatcacacctccaagaccattgccttggccagtgccattctgtgtgtgacatgtggcttccagtgatgctcaaagtattttccgccaaaggctaatagagaacacttcaaacctgggcagcagcatctctcccacagggtttaatatttatacttgtagccacgtggctggctttgtgcttctcatctctgaagtatggaacaggagccaacaaaggctgtcaatagttggagtagtgggattttccaagacaaaagcgtgagttattctcgtccacgtgtttgctggctgctcactggctcaggcagccccttggcaagctctgtggctgaggctttaaataaatagatgtagtttttgtttcacaaccactgaccttttctggaggcactgttgattctgggctttaattggcttctgttgagtgacacaaggtgaaccctctcttcaagagcagaagctcctatctgctgttaaccaccagcatcaattcaaagcaaatgccagaggaccacatacctcactgaactctggggactggggttacttgtagttatgtctcaataaatactttttatattttaacttttgcatttttaagttgtaaaagctatacacactcatggtaacaagtctagtaagacagcagtatataaagaaaatatggccaggcgcagtggctcaccccatagttccaatactttgggaggccgagatgggtggatcacttgaggtcaggagttcaagaccagcctggccaacatggtgaaaccccatctctactaaaaattaggctgggtgcggtggctcactcctgtaatcccatcactttgggaggctgaggcgggtggatcacaaggtcaggagttcaagaccagcctggccaagatggtgaaaccctgcctctactaaaaatacaaaaattagctgagcgcagtggcaggcacctgtaatcccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaattggccaggtaaggtggctcatgcctgtaatcctggcactttgggaggccgaggtgggtggatcacctgaggtcaggagttcgagaccagcctgaccaacaaggtgaaatcccatctctaccaaaaatacaaaaattagctggacgtggtggcaggcgcctgtagtcccagctactcgggaggctgagacaggagaattgcttgaaccagggaggcagaggttgcagtgagccgagatcgcaccactgcactacaacctgagcgatggagcgagactctgtctcaaaaaaaaaaattagtcaagtgtggtggcgtgtgcctgtaatcccagttacttgagagggtgaggcgggagaatagctcgaaatagcttgaacccaggaggcagaggttgcagtgagccaagattgtgccactgcactccagcttgggctaccgagggagactccatctcaaagaaaaaaaaaaagaaagaaaatataagtaatctccaccttctctcactcccatctttctgacaaaaccactatttaaagcgcccaggctgggcgtgcgggctgacatctgtaatctgagcactttaggaggcagaggcaggaggatagcttgggtccaggagttcaaaacagcctggacaacatagtgaaactccgtctctatgaaaaaaaaaaaaaaatagccaagtgggtggtatgtcatcctagctacttgagaggatgaagtgggaggatcgcttgaacccaggaggttgaggctgcagtgagctgtgatcatgacattgcactccagcttgagtaacagagtgagaccctgtctcaaaaaaaaagtttcatgtgtattcacatgtcacgatcacagctcactgcagcctcaacatctccagctcaagggatccttccacctcagcctgccaaataactgggaccacaggcacatgccaccacacccgtctaatttttaaacatttttgtagaaacgaggtctcactgtgttgcccaggctgatcttgaattcctcggctcaagtgatcctcccacctcagcctcccaaagtgctgggattataggcatgagccactgcactcagccccttcactccttttctatgttcaaacaaacatatgagtgtgtagacttattttctattgtatgtgaaaatggaatcatatatgttattatttctttcattttatttagtacatattatgtacattattctagattaacacatataattgatccaatttattatttttaatagctacctaatattccattataggaggttccataatttcttcccattcattacttccccattgatagatattcatgtttttcttccaactttttttgcacaacaacttatgctacaataaacattctacatttattcctatactttgggttttatttccataggagagattcccaaaattgtcatttttgggtcaaagggaatacacaattttaattctcactgtaggtctcctttacagcagttgtttctctcctccttttgtctttctctcccctctcccaccacattttgccagcagggcctgtgtgtttaagaaggaaagcctgcagtgagaactcctctgtgccaagtgtggattatatcagcttagtggggaactggagtctgcagtgtctcagttacattgtgtctctcttgcttttggttggccagactgttcacaattccccttgctgatttattccatgctgtggaattatacatggtcttcatccgtggcaggatcatctgaggggtggctttttgggaagggtgtcttttcagaaagaataggctcagttactgtactttctcacaaagctatatctgttatgtttttttgttatgccctttctttaatagttggattgaaaaaggttcttcaattcccatcccggtcttctgtcttcattttgaggacttgggatttagggagttttatgagtatataatcaatcaactgtaactgattatttgacatgaggataattagttaagaaggtaggggtcttggagcttaaggatcagtgccaagcaacagacgtgaacatttttaaacaaatggttttaacaaacccggtattaggagcaagcttcccaggagtactaagctttcattttttaattttgcccttgctgggatgtaaaacttcagtctagtctaccagaatagagaggagctggattctccaccacaccagggctggagaggagaaaatgtcagagaagcgttaagggaagctggtaagtacaaataagtgaaataaatataaacagtgaactgacaaaatggcaaaaagtgaatgaaatttgaaaatcctcagctgaagattattgtgtaaccagtggtcctgtgagctagtggacactttataaaaatctgtgatctctaaaacatattagataccccagtgtgaatctgtgttcagaatacaaccattagctaagcaagacagagaaatgataagtcctgttggcagatattttgctattgacttctataacatatgctgcaatttttactcagcagctttggaatggatttctatgtcctaggttgaaaactaaactaaaagaaaaacagaatagaagttactgcacttaatttctaaggagaaaattttaactttagtttgtgcatgtatatgcctgcaaaataagcattaccctttatgttaatacaaacttcacatgaatgtttaattttcaaatatgcactgaccagtaataatgatggcaaaattagactctatagtaggtttatgttttataacttagggattctataatgtatcttagttgatgtcgtagttaatagtaaggatagtaatatcttatacagtttgcactgtcgtctgagtaaagattatctttaaacatttgttcctgtcagaaaaattttaaggctaaacctattataagatattaagcatctgattttggctataatggactatctgtgagtagatttttactcctatacaggacatctagaaaagctgagttttaaaaatctatttgaaggcatagaagacctaataaggcagctaggacttgagagctaagacctcagaaagaagagaaactcattgagtgttccaaattctaggctactttttccctgtagacacttaccatttttaagtagcacatgaggagaacccaaacaataagcagctgctaaaatcagagaagccaggcagattattccacagtctgatagggctggggaggaaaaaaaaaaattgaattcaaggaaaccaaatgattcaggacatgagaaaccatgatcatggacagaaaagaggcccagaaaaatcaactcaatagtctaagcaattttccttccaagtcattcactgatttataagtagcgcagaccaagaggttgcaaaaatccaaacacaaagaaggtgctaaaaagctgagaagctaatcagagctacttgcaatcttattacactaggaagataaaaattattatagaatgtaaagcccaccaatgtggtatggcctgaaaaacaccctaagctttcagttgggactgctgacggattatgcctgaccagttaaaggaaaccagaaatagacccggtcaaataaaatattgaagtccatttcccgatcaacttagtcactgattagattaaagtaatctgttcttattttaacaccctagcataagtcttctccatattctttggagaagaaaaaatgatccagaacctgtgtatttttcatatgtggtttctggtattcagcaaagcaaaacaaaacaaaaacaggcataccaagatatagtttccagaatatggtacagagagaacccagacttcctgagttgagaagacagagctccccatgtctggggagaccagggcaactagagtttgtaggacagagtattggagaggagagagctgcagagagaaccccagagttcctcacagggtacacctcaagtataaagctgagtactgagcagcacatgcatgtaaggaaactacctgggataaagaaagaactacccaaaaggattagaagaaatagtgctcattgttcacacagggctgggaattgtgcctattcccaccagctagacttgaaaagctcataattcatggagggttgggtagtatactttgaaagaccatgccttagtagtgggaagtagccctagattgagcactgcactgatcctgtctaacaaatcttttaaaaagacccaaaaggaacaaattgttccagttaatttgactgcatcccagaacaaagctcaaaactatttagaggtatttggaatagcagtattagtaatattgcagagggaagaatattgccagggataaagaaaatcatttcataatgataaaggagttgattcatcagaaagacataacagtactaaacatttatgcatctaataacagaacttcaaaatacataaatgagaaattgatagtgttccaaggaggaatagacaaatccataactgtagtccaaagtttcattaaccttctctcagtaattgatgaaataacagaaaataattaggtatataaaagaagataaaaatacaatcaactagcttgacctcattgatctttataagatactctacccagctacagcaaatacatattcctctcaagtgtacatggaacatttatccagttagaccatattctgaaccataaaacaagtctcaataaatttaaaaggattttagttatataaggtgtgttcttgatcacaatggaattaattaagaaatcagtaacaaaattctcaaatatttggtaactaaataacatccttcagaataactcattagtcaaaggagaaatcaaaaggaaaattagggccgagtggagtgactcacatttgtattcctaacactttgggaagttgaggcaggaggattgcttgaggccaggagttgaagatcagcctgggcaacagagtgagagcctgtctttaaaaaaaatagaaaaaaaaaattagctgggcatggtggtgtgcactcataatcccagctacttagctggaggattgctttagcctaagagtttgaggttgcagtgagctatgatcatgccactgcattccagcctgggcagcagagtgagaccctgtctctaaaaaaattatttttaataaaaaataaagggaaatgagaaaatatttggggctgaaagtaaaagctcatatatcaaaagcagtacttaggtggaattttatagtattataagcttataaggtggggcacagtggctcacgctggtaatgccaacactgtaggaagtcgagacaggcggattgcttgaaatcaggagttcgggaccagctttgacaacatggcaaaaccctgtttctataaaaaatacagaaaattagctgggtatggtggcacgtgcctgtagtcccagctacttgatgggggctgaagcaggaggatcacttgagcccaggatttcgaggctgcagtgagccgagatcacaccactgcactccactccagcctgggtaacaaagtgagaccctgtccccccacacccccgcaaaaaaaagcttataagaagaaaggtctcagattagtgtcctcagctttcatcttaagaaaccaaaacagaaaaagagcaaatgaaattcaaaataagcagaagaaagaaaataagaaatatcaaagcagaaatcaataaactagattttgaaaagtagagaaaatcaatgaaagcaaatgctgtttcattgagaatattaataaaattgattaacctcttgacagaaaacaggaggaggaaaaagagaggagttacaatttaccaatatcggaatgagagaggtgacatcactacaaattctacagatactaatggataataaggaaacattatagcttttctccaataattccatcaacttattaatagatgaaatgaacaaattccttgaaagacacaagctaccaaagttcactgaagaggtagtagagaatgtaaaagcccagatctattatagacagtctcgaaagttagaaatagaagagaacttccctagcctgataaagggaatctatgcaaaacgtgcacctaacatcatatttagtggtaaagcaaatagtaatataatcgattttttttcttttttgagacagagtcttgctctttcacccaggctggagtgcaggggcgcgatcttggcccactgcaacctccacctcccgggtccaggcgatcttcctgcctcagcctcctcagtagctgggattacaggcacatgccaccacaccctgctaatttttgtatttttagtagagacagggtttcaccatgttggtcaggctggtcttgaactcctgacctcgtgatccacccaccttggcctcccaaagtgctgggattacaggcgtaagccactgcgcccagctttttttttttttttttttttttttgagatggagtcttgctctgtcgcccaagctagagtgctgtggcgtgatcttggctcactgcaacctccaactcctggttcaagtaattctcctgcctcagcctcctgagtagctgggattacaggtgcccaccaccatgcccagctaatttttttatttttagtagagaatgggtttcaccatgttggaccaggctggtctcgaactcctggcctcaggtgatccgcccaccttgggatcaccaagtgttgggattacaggcgtgagccactgtgcctggcctgcctagacttttaacttatttgtgtaattacttcaagtatagattactccaatttaaacacaaagattgtgaaactagatgaagaataaacatattcaaaatgattattaaatgttttaattggtgacagagtttttcatagccttttatcatctcagtgcatcatgttttatttgtaggtagccacagagaaacagctacatttataagaacaccatgaagaataattaaaatgttctttttttttttttgagacagagtcttgctttgtcacccaggctagagtgcagtggcaagatcttggctcactgcaacctctacctcctgggttcaagtgattctcctgcctcagcctccctagtagctgagattgcaggtgtggaccactacacctggctaattttttgtatttttagtagagatggggtttcaccatgttggccaggcttgtcttgaactcctgacctcaggtcgatccacctgccttggcctcccaaagtgttgggattacaggtgtgagtgaccacacctggcctaaaacattcttttatccctgacttcagctgagtttagtttgaaatgaggctctttatttggggtgattgggctttgcaggagggttggtgggtggcctataattccccccaatattgtatgtaagatattacatgtttgtatacagtttttcaggagagagtccgtagctttcatcagtctctcatgaccaaaaactatttaagaatcatggcttgaagaatgaaagaatcgagtgccatgttaagtgtctaatttctcaataatacttccctgaaactaatttctagagaataattcaaatgacttgatctaaatatgtgtgcatgagtcatcaaagcagcctggagtaacatattaaaagttatcccaagggtctgtctggttcaaactctgatgaaagccctatatttcttatcctggactgggtttctcatagtatgattcccagatcagcagcagcatcagcatcacctaggaacttgttagaaatacaaattctcaggccggccccaggccatacctactgagttacaaattggagatgggaccaggaatcggtgttttctaaggagctttccaggtgattctggtgtgcactaaagtttgataaccactgggttaggctataattagaaaatcctgttctccgccccgctcccaagccaggtttagaacagtttgttaagcaagtatctgcagaaagaccagtctaatgttgacagcttctattttccatctttatggaaaaatcgtaaagcctcaaaagcccaaatcaccctcacacaagtgtcttgggttgcacagcaacaccaaacaacagtttagagtaatccaatgtccagctgaaattggaattatagagacacagcatgtgagttcactcacaaaaatttttaccaggaggctttttagggatgagccccgtaattccaagggccttggctctcagcctcctttgaggcatataacacagtctcttgaacagactgaccctcagtaatgaggtttcattaccctcttccagacatgtggcaccctcacaaacatcctttaacagagtgctcagtatcaccatgcttcgtttgcaaagtaacttaatgaattcgctcagcctatattcttagtacccagtggtagggatctcagctgtagcagcataaaacttgaactgtccaaaaccagtctctgaaaccttcaagtgtttattctgtctactcctgctgttgcttgaagcttgatttgttgttacaccttactgttttgctgatgagaaatagcacagggtacttctcagtggttctcattaaaggagggcagccaagtggaattcattcttggctcttaatagttttcaaatgagaattttattgcatactaatgagcactaattgacatttgtgactgttttttatggaaataatgcatgtacaatttgcataatagtacctaagtgcttttaggtaacagtacaactctgggaagttggtgaaggtttttgtatgatgctttttaaaaaagttcccaaaccccagcccctagaatagtatagaatattaacaggtctctgggatccaaatataaggcagtagtagtgactcagttcctgtagttgtaccagcttgtacctgagagtcagaaaatgcatcagggcaggtctctaaaagcaggaagcgctcccacagtagccagggaggatgttccagccctctctaccttcatgtgtcaaccctcctgcttctcctaagtcatgagtatctagacagtgctgaggattgttccaaggactcctacactgtaaaatgttttctaaacatcacttggttgatatcaacaaacatggattgatcacctactatgtgccaggcactgtgctagatgccagagtaagcccatgttggcttgctgcctgctgcatccctatctcttagcacaatgaggcaacagttatccatcaatgtttattgaattaatgaacatgctgtctgccctcagggatctgaggattcattattcttacaaaatctgacgttgaatacagtataaaatttgttgctcttcatgttagaaatattaattattcagaacttggaattctgttaggaaatttagagaaacaagataatcttggttttatgtgccccaagttttctgtatatcaaatgacccttttaaattttgtgaaaatgaaagaagccaatgtttactgaagatctagtacgtatcagttacttttgcacacatcctatacatcctatgatttaagcatcaacaaaacctatgaggtgtagatagtattatctgtgtttaattgagcaagcagctaagaactggagaagtgactaacctaaggcatcacagatagaaaattgtggaactgggacttaaattcagcctaggctgtgtctgttgcactgccgcttattacattaaatgatcctaggatatgttaagcaaagccaaactctgaagtattgtactagtgatacggctccgatgactggaggaacactggggttcttggtctcatgccggtttggataaaatgacatggacacacgtggagtggttttagggagggaaaagtttaataggcaggaaagcaggaaggaagaagaaaacagctccccggtacggggagagaagtagggggattcaaacaaagagaaaacctcatgtgcggcagaaaagtggctgcttatatgaggatgcaggaggaggtggtgtctgatttgcatagggctcaggggattggtttgaccagtcatgtcattcctgcagcctgtgaaaaaactgaccctcccaccctagctttttaatatgcaaatgcagggcgccattatgttttacacacatggggacatgtgggggtggccatgttgccaggcacatgtaggggcaagggcaagaagatggcaggaatcaccatgtttggatggacccagtttctaatggctggcatttgcatatcaaagcttgctggcccagctcagagccggggctttcctgctagacaagaaacgtttctggagctgctttaaaagaaataaaaactccccaaggaccccttttcctctctatctgcctaaaataatttattaataactcctgtaacactaggatggagggatgaattggtccaggggtcttggtgtgtgccctgcattcagttgacctactgtttacaatacacctactgtttacaacactattttctagatcttgtggggaacccaaaccaagggccagtctggctcacctataattccaccaagcagccagaaaagtataaacgctctacagcaaagggataaatcaaggtttagtagaagaaaagctttataagtaatgtggaactaaaaggttgaatatagttttcaataatgttgagcataaatgttctccagattgtggaaagatcactaactgttggctgggaagggtaggagaggagagagtttgaaacacagagaataggaaggagtggtgatgtagtccaataactcacccagaacccatggacgtgaaagctttgtttgctctcagatccataactagactaaaggagtgaatcagatctgctcccctgcaccccaccctgctcaccttccacacctgccaagggccacccagcaattccattctgcttgtcaaatcccctaaggaggatatgtctggaacagccaccactcctccccctgctcttccctctggtatgtcaggattccctgcacaaccgtgctccagggtccttgggatgattattcagaaaccagagaagtatgtagaaaacttaatcggaggcacttaaaggctttaaaagggaattttaaaaaccatctttccctcttttataaggcagtctgagtatttaagaagcaaattaattgagtccactttacagtgttggggcaaaagcatgcaagttccaacatttacacactaacagaaaattcttttcccttccactgtgctccttttctttcttgggcctgctccacaaacttctaaccacagtcctaaattggtaccccatgaccctgtgtgcttcgattgcctacactggtttcagacccacgctgtggattcaaatcaaacctgcctttctccctgttactatgtccacccagcaccctccttgcacacacagtctttctcttctttcctccatgtgcagacctttaccacagctgtcccaaatgtgtgaaaggccaaccataactcttcctttaaaggtcctttagagcagtatggaaagagtgctgaacttggaagacctagattctctttctatactcattatgtgatcctgagcccctcacttaaccttgcagggcacttacaaaataaagagatggagttcatgatatcttaaggtcattttccatgtccaacattctctgactcttcatctttccctgactcaacattctgttcctatatagtcaacaccttcccaccttaatctcatgctcatgccctcttagaaagtctttacaactgttgagggtgcagtggctcatgcctgtaatcccagtactttgggaggccagagtgggcagattgcttgagctcaggagtttgggaccagcctgcataacatggtgaaaccccgtctttattaaaaatacaaaaaaaaaaaaaaaaaagccagatgtggtggtgcttgcctgtggtcccagctactcaggaggctgaaatgggaggatcacttgaacccaggaggcagaggttgcagtgagctgagatcatgtcattgcattccagcctgggtgacagagagacaccctgtctcaatttaaaaagaaaaaaaagaaagaaagcggcgggccgcggtggcttacacctgcaatcccagcactttgggaggccgaggcaggtggatcatctgaggtcaggggttcgagaccagcctggccagcattaagaaactctgtctctattaaaaatacaaaaattagctgggcatggtggtgggcacctataattccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtcctattgtgggtcagtaggagcccgttgattcatgtccttttgacattattctgtagtttttgatactttttttcctagcatgatgagatgttccaggcttatgtcgtatatttcttgttccgtaactcaaattgaccattttgttaatgaaacttgatttttttcagtgaaaagtggttttatagaacacaatctgggcacttgaagtgtttattgttactgggttgtcattacttacaagactcagttaacaaattaggaaaaagattgatttagaaagaaaataaatcctgagttcatattgttatttccaatttaaagattaaagggttttcgtataacttattttatatgtgtatgtcttttctcttactttgaaatcttggtttccaataacatgaacataattacttcctttatcctaataggtacgtatatgtgtatatgtctatgtatgtatgtatgtaggtatgtatgtgtgtatgtttctatctgtaaaacaggaaaaatacccacctaatggagcttaagatttctttatgagtattttttgtccttagggtatttaatcaaattactgttacttaaaataatgtttctctatgtggttatgccatcaacttcatatacaattattttatttcaatttgtcttcgatttttaaggatggttttcttcttctgatttaattttgtttttaaattatgtaaaatattttcttggtttcagagtcaaatctatgaacattgagaggtctattttgcctctctgtcccctcccccttattattttactccccttatagataatgcttttatttttccattactttttttttttttttttggagacaggagtctcgttctgtcacccaggcaggagtacggtagtgtgatctcggctcactgtaacctccacctcccaggttcaagcaattatcctgcctcagcctcctaagtagctgggactacagacactgaccaccatgcctggctaatttttgtatttttagtagagacagggtttcactgtgttgatcaggctggtctcaaactcctgacctcaagtgatccgcctgccttggcctcccaaagtgccgggattacaggtgtgagccaccgtgcccagcctctattactttttgaaaataagccaatgacctatatgtatcctatctcctttcttacacaaaaggtagcaggccagagttcaagattacagtgagctgtcatcatgccactgcactttagcctgggcaacagagtgagaccttatctctaaagaaaaacaaacaataaaaaattttaaaaataatttctatgaattaaaaataattttaaacacaactgcatatgaagacaacaaaggaaaactctcaggaaacactgaaatatgaaaatcaagtgagattagagcaaataaggatgtgtatgggaaggttctgtagaagacagattgaggcccaaacagagagagctctaaatacatcatgaaggttaccagaaatgtgagaaattcctgaagaagagggaagaagcaaatcctctccaaatttagttcacttagttgataatcattagttgattcccagtagagtcagtcttttatcatcagtgccaccactgttgttctctgcattaacaaaggagatattaatctggaaagctgcaatcattttcactgtagaatcagccttttattttttagggttttttaattttttttttttaggacaccttcatttaagatcacttcatatctcctctggcttttgcaaatgctctttggctgatctactgtttccaccactgtcctcaacattttttagtatattatttaatttatgtatgtattggtgtccactgattattgtttgccttcccccattggaacacagattctataaaagtagggatctttattttgtttaccactgtattccaggtgcctagaacagttcctttcacattgttggtgctcaaaaagaaaaaagttaaatgaatgaatatcagcagcaagagcattttgaggagaaagcaaaggtgtaactgtgggggtctccattaatgtatgtatatcatcctcttatacatttgtcccatcacccgctagccctggaactctcattatttttttttctggtaatgcaggctccaactcaactggcaatgagaatatgaactgaggcaactgtatttgaaaaatgaaagaatataggtgatatgggtttaaagaattcagtatttgtgtatttttccaataagtacatgcttatgagcatagccttacaaaataacaaaaataattttttacatttactcacacacttaccatttccagcactcttcattcctttgtatagatccaaatttgtatctggcatcattttacttctgcctaaagaactaactctaacatttttttatagtgcatgtctctcagattttctttgtctgaaaattactttattttaactccatttctgaaatacattttcagtgggtattgtattctgggctgactttttttttttttcccagtgcttgagagatgccattccattctcttgtggctttcattatttttgatgaaaaatcagttgtaagtcttactcttgttcctctgtacataatctgactgctgcttctaaaattttatctttattgctggtttttagcaatttctgtgccttgttttgtttttgttatttagtgtttgttctgcttgggattggttgagcttggatctgtaggtttatacttttcatcaaatacgaaaaattttggtcattatttttcaaatattttttctactcctccctcctcactttttccccctcaaacagcagttacatgtatgtcagacaacttgctattattctataagtcattgagacaatgttcattcttttttatttttaatttttgtgggtaaataggtgaatatatttaggggttcatgagatgttttgatataggcatgcaatgtaaaataagcacatcatggagaatggggtatctattcccttaagcatttattctttgaattaaaaacaatccacttacactcttatcacttctcagccttttgggataagatcatgtgtaaaaacaatgtacttacacttttcattttaaaatgtacaattaagttattattgactatagtcaccctgttgtactatcaaatagtaagtcttactcattctaactaattttttataaactttaactatacccacttctcctcccacctcccactccctttccaacctatggtaaccatccttctatactctgttcatgagttcacttgttttgatttttagatcccacaaataaataagaagatgtgatgtttgtctttctgtgcttggcttatttcacttaacgtaatgatctccagtgccatccatgttgttgctaattactggacctaattcttatacatggatgaatagtacatcattgtgtagatgtaccacattttctttattcattcatctgttgatggagacttagattgcttccaaatcttagctatagtaagcaatgctgcaacaaacaggagtgcagacatctctttaatatactgcttttctttcttttgggtatatatccagcgatgggattgccagatcatacagtagctcaatttttagttttttgaggaacctccaaactgttctccataatggttgcactaatgtacattcccaccaacagtgtacaagggtccctttttctccacatcctcaccagcatttgttattgcctgtcttttggatataagccattttaactggggtgagaagatattttagttttcatctgcatttctctgatgataaatgacattgagcatcttttcatatacctgtttgccatttgtctgtctttgttggaaaaatttctgttagctcttttgcccatttttttaatcggattattaaattttttcctatagagttgtttgagctccttatatagtctggtgattaatcctttgtcagatgggtagttggcaaatattttctgtcattctgtgagttgtctcttgactttgttgattgtatcctttgatgtacagaggctttgtaacttgatgtgatcctatttttccatttttgctttggtcgcctgtgcttgtggcatattgctcaagaaatgtttgcccagaccaatgtctagagactttctgcaatgttttcctgtagtattttcatagtttgaggtcttagatttaagtctttaatccattttcatttgatttttgtatatggtgagagatgggtgtccagtttcattcttatgcatgtggatatccagttttcccagtaccatttattgaagagaccctctctttcccagtgtatgttcttggcacctttgccaaaaatgagttcactgtagtttctgggttctctcttctgttctattggtctgagtctgtttttatgccagtactattctgttttagttacaatcattctgtagcataatttgaagtcaggtaatgtgattcctccagttttgttcttttcactcaggatacctttaactattctgggtcttttgtggttccacataaattttaggattgtattttctatttctgtgaagaatgtcactggtattttgatagggattgcattgaatctgtagattgctttgggtagtatggacattttaacaacattgattcttctaatccatgtatatgggatatttttccatttttggtgtcttcttcaatttttataatctgtgttttatagttttcattatacagatctttcacttctttggtcaggttaattcctagatatttaattttatgtgtggctattataaataggattacatttttatttctttttcacatagttcactgttggcatatagaaatgctactgattttttataaacttttatgttatgttcaggtgtataggtacaggtttgttatataggtaaactcatgtcatggggtttgtcgtacagattatttcatcacccaggtactaagctagtacccattagttattttttctgatcctctccctcttcccactcttcaccctcagtaggccccagtgtctgttgttcccctctgtgtgtccatgtgttctaatcatttagatcccacttgtaagtgagaacatgcagtatttggttttctgttcctgtgttacttttctaaggataatggcctccatctccatccatgttcctgcaaaggatataatctcattctttttatggctgcatagtattccatgatgtatatgtaccacattttctttttttttcccttcaacttttattttaagttcaagagtacatgtatgtacaagatgtgcaagtttgttacataggtaaatgtgtgccatggtagtttactgcacagatcatcacatcgcctaggtattaaggccagcatccattagctattcttcctgatgctctccctccctcaccacaccccctccgacaagccccagtgtatgttgttgccccctcacatgtgtccatatgttctcatcattcagctcccacttataagtgagaacatgtagtgtttgggtttctgttcctgcattagtttgctgaggataatggcttccagctccattcatgtccctgcaaggaacatgatctcattcctttttatggctgcatagtattccatggtgtatatgtaacacattttctttatctagtatatcattgatgagcatttaggttgattccatgtctttgctattgttaatagtgctgcagtgaacatatgtgtgcatgtatctttgtaacagaatgatttatattcctttggatatagacccagtaatgggattgctgggtcaaatggtatttctgcttctaggtctttgaggaattgccacactatcttccacaatgattgaactaattcatactcacaccaataattcctttttctccacaacattggcagcttctgttgttttttttgactttttaataatagccattctgactggcatgagatggtatctcattgtggttttgatttgcatttctctaatgatcagtgatgttgagctttttttttcatatgtttgttggccagatgtatatcttcttttgagaagtgtctgttcatgtcctttgcccactttttaatggtgttgtttgtttttcttgtaaattggcttaagttccttgtagactctggttattaaacctttgtcagatagatagattgcagaaatttttctcccattctttaggttgtctgtttgctctaataatagtttcttttgctgtgcacaagctcttaagtttaattagattccatttgtcatttttgctttcattgcaatcactttcggcatttttgtcatgaaatcttttcctgtgcttatgtcctgaatggttttgcctagactttcttctagagtttttttttatagttttgggttttacatttaagtctttaatccatctccagttaatttttgtatgtggtgtaaggaaggggtccagtattaattttctgcatttggctagccagttcccctagcgccatttgttaaatagggaatcctttccctattgcttgtttttgtcaagcttgtcaacagtcagatggtggtaggtatgtggtctgatttctgagctattttgtttcattggtttatgtgtctgcttctctacaactaccatgctatttgggttactgtagccttgtactatagtttgaagttgggtagtgtgatgcctcaagctttgttctttttgcttaatattgccttggctattagggctcttttttggttccatatgaattttaaaatgattttcttctaattctgtgaagaatgtcaatggtaatttaatgggaatagcattgaatctataaattactttgggcaatatggccattttcatgatattgattcttcctatccatgaggatgaaatgtttttccgtttgtttgtgtcttctctgatttctttgagcagtggtttgtagttctccttgaagaggtccttcacttcccttattagctgtattcctaggtattttattctttttgtagcaattacgaatgggagttcattcacaatttggctctctgcttgcctgttgttggtgtataggaatgctagcaatttttgcacattgatgtttatatccttagtctttgctgaagttgcttatcagcttaagaagcttttgggctgagacaatggggttttctagatataggatcgtgtcatctgcaaacaaagataatttgacttcttctcttcctatttgaataccatttatttctttctcttgcctgattgccctggccagaacttctaatactatgttggatagaaatagtgagatagggcatccttgtcttgtgccagttttcaagggaatgcttccaacttttgcccattcagtatgatactggctgtgggactgtcatagatggctcttattattttgaagtatgttccttcaatacctagtttattgagagcttttaacatgaagggatgttgaattttatcgaaggccttttctgggcctattgagataatcatgtggtttttgtcttttattctgtttatgtgatgaatcacatttattgatttgcatatgttgaaccaaacttgaatctcagggatgaagccaacttgatcgtagtggatacgctttttgatgtgctgctggatttggtttgccagtattttattgaggatttttgcctcaatgttcatcaaggatattggcctgaaattttctttttttgttgttgtatctctgccaggtttggtatgaggatgatactggcctcaagaatgagttagggagaagtccttccttttcaattttttggaaaagtttcagtagaaatggtaccagcttttctttgtaccgctggtagaattcagctgtgaatctgtctgatcttgggctttttttggttgttaggctatttgttactgcctcaatttcagaacgtgtcattggtgtattcagggattcaatttctttctgcttcagtcttgagaaggtgtatgtgtccaggaatttatccatttcttctagattctctagtttatgtgcatacaggtgtgtgtagtattctctgatggttgtttgtatttctgtgggatcagtgatgatatcccacttaacatttctgattgtgtctgtttgattcttctctcttttgttctttattagtctagttagttgcctatctttttattaattttaaataaaacagctcctggattcattgatttttttgaaaggttttttgtgtctatattttcatttcaactctgatctgatcttggttatgtcttgtcttcttctagctttgaaatttgtttgcttttggttctgtcattcttttagttgtgatattaggttgttaacttgagatctttctagctttttgatgtgggcatttagtgctataaattttcctcttaacactgcttcagctgcaccccagagattctggtatgttgtctctttgttctcattagtttcaaggaatttcttgatttctgccttaattttgttatttacccaggagtcattcaggagcaggttgttcaatttccatgtagttgtgtggttttgagtgaatttcttaatcttgagttctaatttgattgtgctgtggtcagaaagactgttatgatttcaatacttttgcctttgctgaaaaagtgccatgtggtgatgagaagaatgtatattctgttgtttttgggtggagagttctgtagatatctatcaggtcctcttgatccagagcttagttcaggtcctgaatatctttgttaattttctgtctcagtgatatgtctaatattttcagtggagtgtcaaagtatttcactattattgtgtgggagtctaagtctctttgtaggtctctaagaacttgctttatgaatctgggtgctcctgtattgggtgcatatatatttaggatagttagctctgcttgttgaattgaacgctttaccattatggaatgcccttctttgtcttttttttatctttgttggtgtaaagtgtgttttgtcagaaactaggactgcaacccttgcttttttctgttttccatttgcttcataaatttttctccattcccttattttgagcctatgtgtgtctttgcacttgaggtgggtgtcttgaagacagcatactgatggcccttggctgtttatccagcttgccattctgtgacttttaattgggggcatttagcccatttatatttaaggttagtattgttatgtatgaatttgatcctgtcatcatgatgctagctggttattttgctgacttgtttttgtggttgcttcatagtgtcactggtctgtgtactttagtatgtttttgtagtagctggtaacagtttttcctttccatatttagtgcttccttcaggagtgcttgcagggcagcctggttgtgacaaattccctcagcatttgcttgtctgaaaaggatcttatttctccttcacttatgaagcttagtttggcccgatgtgaaattctggattggaaatatttttctttaagaatgttgaatattggtttccagtctcttctggcttgtagagtttctgctgaggagtccactgttttctgttgggcttccctttgtaggtgacctggactttctctctggctacccttagcattttttttttcattttcaccttggagaatctgatgattatgtatcttggagttgatcttcttgtggagtatcttactggggttctcggcatttcctgaatttgaactttggcccatcttgctagcttggagaagttttcctgtatgctatcctgatgcatgttttccaactcagttccattctgcccctctctttcaggtaccccagtcaagtcataggtttggtctctttacataatctcatatttctctgaggttttgttcattccttctctttttatttgtttctgtattcttgtctgcctgtctatatgcagaaagatagtgttcaagctctgaaattctttccactgcttggtccatcctatggatacttgtgattgcattgtgaagttcttgtgtattacaagaactttatttttttatctttatccagtctaccattgatgggcatttaggttgattctatgtctttgttattgtgaataatgctgtaatgaacatactagaatgattcatgtttatttgggtaaatgtgtgttgatttcgtatcctgcagttttattgaatttatcagttctaatcatttttcttgtggagtctttaggtttttccaaatataagatcatattgtctgcaaacaatgatcatttgagttattccttttcaatttggatgctttttatatctttctcttatctaattgctctagctaggacttccagtagtatgttgaataacagtgatggcagtgggcatccttgttgtgttccagattttagaggaaaggctttgtccttcccctatgccccaggtaggtccaggagtcaaggactagagtccaaaaccttagaagtctacctggtattctattatactgtggctgagctggccctcagaccacaagacacagtccttcccactcttctctcccctttccaaaggcagaggaactgcctttagtagagacagggtttcgccatgttggccactgccaacccagcccatgaggaggactgccagactactgctgatgttcccttaaggcccaagttctcttaaatcagcttgtcctgaatgttacctagcctgagactcacccttcaggacagtgggctcccctctggcccagggaaggtccagaaatgctgcccaagggtcaagtcctgtaatcagggactccaagagccctcttggtattctaaccccctgtatctgtggtggtacctaaggtgcaagacaaagtcccttttacatttccttctgcttttatcaagcagaagttttgtcctgcagccaccacagctggtaatgtactgagttctacctgaagccaggaagtctcagaggctcacccaaggccctcaacatagtccctggttattgctgctggttattcagaaccaagggctcttcacttagcaggtgataaatgccggcagggctgggtcctttccttcaatgcagtgggttccctctggcccagggtgtgtctagtaatgtcacctggtttctagggcctagaatggaggcctcatgactctgaccagtgccctatcctgctgtggctgcgctggtatcctagacgcaagacaatggtctccccacttctccctctcctattctcaagtggaaggaaggggtctcttttggagctgtaagctgtgtagcctggggtaaggggaggggtgatgccaatactctcttggctgccccagctggtgtctcagtaggttgcatgcactcccagtctgctgtctctgggcctagttcagcaccaggactcacctaagagttgcagtccttatggcctagactgcttttgaagtttacttggagacaaagagcactgtggccttcactggtgaggtttacaggcactcaagtttagaccactgggattggtgattcttctctggctagggctgttttaaatcctccctccgtttgcacatttcagctgagtttgatctagtttgcctttctgctctgatttctggttcttatgaaggtgtttttttctgtgtagacagctgttaacttggtgtccttgcagagggaatgatcagtggagccttctatttcgccatcttgatccgccgccatatatcattcttatcaatcattttctgtttatgcacctgaaaatacactggtatacaaaattaagatccttactttcacagaatttgtgttctaatgggggaagtcaataatcggtggacaccaatacatatataaattaaataacacattaaaaggtgttgaggacatgctgggcatggtggctcatacttgtaatcccagcactttggggggccgaggcgggtgcatcacttgagatcaggagtttgagacaagcctggccaacatggtgaaaccctgtctctactaaaaatacaaaaattagctgggtatggtggcaggtgcctgtaattccagctactagggaggctgaggcaggggaatcgcttgaagctgggaggcagaggttgcagtgagctgagatcctgccactacactccagcctggacaacagagtgagactctgtctcaaaaaaaaaaaataaataaaaataaaagctgttgaggacaatggaggaaaaggcagatcagagaaagaacatttacaaaagccagagggagtgtgaagcaattttaaatgaggtcagatttttggataatttctattgctatgtttttaagttaaccaatgtttctttttgcaatgtctgatctgttacatttttatttcagatattatattgttatctctagaagttctatttagatctcctttttatctttcaattctctcctcattttgttcatattttgctttatatcctagagcatatttataatagttgttttaaggttcttgtgtgatagttatatcatttctgttatttctgtgtctgatattatttatctattttttaaaactttatgggtataggtcatattttttcatttctttgaatgcctggtgattattttgaattttacattgttgagcactggatgttgttatattccttttaagagcattgagttgtgttctggaatgcagttgagtttttacagatcactttgatccatttgagactttcctttagggtatatccagagtaacatctagtttagagttaatttgtttttactactaagatgtggcttttctgaggattttatccaatgtcctgtgtattttggggtctctccacactggctgatggaaacacagggtagtctcagccctgtgtgagctccaggaattactcagctattgcctatcagtgtttttttcttcaactccaagtagtttcttccagctcatatccaaatcatacttaggagaagactgggggggatcctctgcagatttccaaagtgctctccccactctctgtatctccctcttcttcattactctgtcccacaaattctaaccacctcaacatccttaaattccaatccattcccccttacctcaggtagaattctaggttctgattggttttccctccacgtgctgtgacctggaaatgacctccaggcagtatctcttaggaagcccagttgtgtggcatctgttgtacaatgcctgaaaatgattctttcatgtgttttgtctggttttcaacttgttcacagaaaaaagcaatttgcacagcagttaattcttcacagacagaagcagaagttctaccaactgcaaaacaaccaaaacaacttgttaaaagacagtatttgtatgactggtcataaattacgtatagaagaatagagattttgtgagaaagatatgggcctgtacagaggggtgaacttgcaaatgaccatcttgcttggggatagtgtctgttttcctgatcctaatcactgggaaggattctgtaatctctgtcaaataaattgcaaacactaccacacatggccttgggtctactactgtctatgacataaacagtttctccctagagacttagttgtgagggtacagggggaaggtagcttttggaggggcctggaagacccttccctttgtgccttcgattctgtatatatcttgtggtcagaagtcttaccattaccctctctgataactccccacccactttcccaatcactaaacactttttgaaaccattcaactctttcctttcaatgattgagcccttcattgtttcatcagctcctcttgtgtgaatctctctgaatgtgtgccaagtttgcagtttaatgcctgtcccatgtaggagcccaatatcacggtatataaagtttctacactggatatccatggactgaagaggggcctagcattcagggttccaagccagtgagtttagcttatccaagggtacctctagaatgtgctcagaaatttattccaagtcagagttgcatcccccaggactttaggctcagatggacaaccccatcatatttacagaatccctcaaagataatttaagtttaagattgtcagcccacctggggtgcacagtgttgaccagggtttcttaaccttagcactgttgacatttggggccagataattctttgttgttcagaccatcctgtgaattatagtatgtttagcagcatccttggcatctacctactagatgtgaatagcatccttctcttaattttgacaaccacagatgtctccagaattgccaaatgtcccctaaaggtgcaaaattgcatagttgagaactactggtaaagaggcactatggcatgccaagctctagggagcccacagaagtgcacctctgggaactaaagctgaagaaacccaagaggccccttggtatcttcttggaagaagttagtccagagtgtctgcaccatgtggagtgtatactgggatgacattgaccttggaatgtaaactcctgggattcttgcctctgcagatttggagcagggttttcttcttctctgcttttcagtttacttatttgaaaatgaggaatggtgtttacatcacaaaacactgtagtgaggacaaaatgaggttttatgtatatatacacccatacatatacatatacacttcttccaaatgatataataatatataaacattgaatgaataatggttcaaatataagtgtacttatttgccactatgattaaaagggcaatataggaaaaatacattttcttctaatccatcatgttgtaataatcctccctgtggttgcagtatggttctgtgctagaaggcacaataggaaatctctaactttaaaaaaaaagaaaagaaaaaatatctttctagcaattaaaatctcaactaaattagaatgcaaataggtttttatatttgcttcttaattttgcattcaataatctgactagaatatgcaataatttaaatgccttgatgggagatagtggcttttagttctcttgggatttcattgtaataaacctggtaaataattcaggaacatatgagaggccaatgaatggtcagcacctggtgctatattatttgtgcctaagcacacagactccaaagatggcactctccacctgtcactgttgttctggcttaaacatgggccctgtgttcagtggctattgagataatagtaatggatatttttgccttgtccaattttcctccacaatcaaagaaaactgtgctaagctgtttaaaaaatacaaagcagaagtggcagcctcttttagattaccactggtaaaatttcaaatctattttctctattaagggattgattgttttaaagaattagggatatggctatcttttctactggtgctaatttgagcctttttgcctttctgtctttgttccacaaggctgagcttctctttagatcacattattcatattgcaaggatcttctgagagaaataacaccatcctctggccagccactcactctgcaggagttcctagagctccccagtttctttccctattgcctgagtagtctatctcacgcctgttagtctcacagtttaaatacaaacacacaaagactcttgcaggcagcttgggtacctttctttgaccccagccgactggacatagagaacaagagctagagagaacaagagctagagtgaccgacagatcatgtgtggagacagcatggggcacctgagcccagcaccatccaggatcagacagaacttaagccatgagctgcctagaaagatcttgggagggcactgggtttcccagtatggaaaaaagaaaaatgtggctcacaagtctaagctaaggtctttacagtactgggccataaacaggatctgaaaagaaactgcagaaaatgttagatatgctttatctttgttttaaaaatattatttactataatggcttaaaatatgttgatttaaatatatgatatttgatacctttgtaatatatataataaagtgtataataaaatataactatataattaaaatagatgatattttaaaacctctctaataaaccatttacgtgtgtgtgtgtgtgtgtgtgtgtgtgtgtgtgtgtgtgtgtgtgtatacatgcctttgtttaacaggtttaattgctttcctttcttcaggaaccagagtgagggtactcgaacagtgactgccatctggtggttaaccagaatcatcaccttgtgtagcctgatggttactaagatgtccactcttgactcacatggcatgcactcgcagcaggggaccagttgaaggatgtctgactttggagggtcaccagttgaaggatgtctgatgaaggagcctagcgaaataaccctttgcttctacctgaatgggttgttcactctggattctgagcctgcagccagctccaaaatggggcctctgaagaaaagatttgagttgctcttgtgtcttagtcaaagatctacatccctaccagtgggtaaccaagactgtgaataagcacacaccaacaggggcatgtggtgacatggagcctgaaataaactgctctgaattgtgtgacagttttcctggccaggagctggatcggagaccccttcatgatctctgcaagacaacaattgtaagtgagcagccacaggatgccagggctgctcagatgtatgtggtggtggtggtgttggggaggaggaggtggagggaaagggggatgaggaaggggaggagtgggaggagaaactgctcatgcaggatacatatttcccagcacttggtgacgatggggcagtttgtttttgacctatagaagatccttcattcctaacagctcctccttattctgtcctcagacatcttcccaccacagcagtaagaccatctcttcattatctcctgtcctcttgggtattgtttggacttttctcagctgtggacttctgctgatacttttctttcttgcctttacaattcactgcaggaagaacaggtaagcagcccagtttctcatcacacatagctcaatcatgaaatcccaaatgttagtatcttttggcagcacaagccactatctggtctcccactacaggattaaaccacatgagacattccctctgaaatagtctacctgttgagaaggggaaagatctaggtcggtattgtgctaactactgcaagggtatccaaagaagagaatgaagagtctctctctataatggaggtacaatccttctgagaagatgaggtatctgtatttaaaatgaagaccatgtagaggattccaaaacaacacaaaaacttgaggacagcacagcagaaccagtctgggtgagttagggtttctgcaaaagcagtgaagcactgctacctggctatttgctagataattctggctgactagaaagtcatcagcttatcagggtaagtatggctcccaggattcgcaaaagaagcaaaatggtgacttttttctgaagggacttatagcaccttgccttggatgcaatttcatccttcctcagggcccatcccatctctcccacccccacactgtaccctcatcctaccacagccgtcccagggtgcctcatgagaagccctgctccagccctctccttagcccacagctgacttctagatggagcccacaatcagaaattaacaacttcctcaaaccagccaaactcgtccagccccactccagccttaccctgtgtggtgaccaagcatgtcgtgctccattgcctgtggatttgacactcagatgagaattggtcagttgcattttgggatgctgttttgccatgttaggcatggaggacgtggaattgttaagcagcagtgattggttgttgggtcagcctcagcatggtggtgatacgtggcactccaactagagtataccccagagactgcctcagccacttttcattctgttcctcaagcacactacgctgactcccatctcaaggcttttgtacttactgttcctgtactgttccctctgcctggaagtcctcctcagatattcccatgactagttccttctcatcttataggtcttggctccagtgtcacctcttcagagacaccttccctgatcatcctatctaaagtagtatccctacccatgatcaccccctcatctcattccatatcctatcagcctgttttatgttccttatagcaagcatagtctgctattaccatatttgttgatttacctgttgattgtctgtatcccctaccagaatggaattctgtgaacacagggactttgcctgtcctcttgtgcccaccactgtgtctccagcatttagaacagactctgggatataataggtgctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgagtattcatgtgtgtgtatatgcaagaaaggagaggaagaaaaatattttaacacaataaaaataatacaaaaatgtttaaatccagttgcagatattgaatttttataaaaatttcaaaaaccagtaaagataaagaaaacttgaacactatcaaccaacttgacccaattgacatttatattacctttcacccaacaacagcagaatacatattcttttgaagtacacatggaacatttaccaagatatatcatattctgggccatagaaaaagtctcattaaatttaaaagggttcaagccgggtgcagtggctcatgcctgtgatcccagcactttgggaagctgaggcggatagatcaccagaggtcagcagtttgagaccagcctggccaacatggtgaaaacccatctctactaaaaatacaaaaattagatgggtgtggtggcatgcacctgtagtcccagctacttgggaggctgaggcaggagaacccgggaggcagaggttgcagtgagctgagatcatgccactgcactccagcctgggtaacagagcaagactctgtctcaaaaaaaaaaaaaattaaaggattcaagtcatataaactatgttttctgacaatgaaattaaaatggaaatcaataacagaaagatctctggaaaatcctgaaatatttagaaactacatagaacactttaatccatggtcaaaaaagaaatcaaaaggaaaactagaaaatattgaccagaattaaaatgaaaatacaacctagatttgttggatgccactaaagcagtattagggggaaatctagagaactaaaccccatattagaaaagaagaaatgtctcaaatccatgacctcatcttccaccttacaaacagaaaaaaagagcaaatgagacccaaagtaagtagaagaaaggaaataataaagatcaggttagaaaataaaataggaaacagaaaacaataggaaaaaaaagtcagtaaagccaaaagctatgaagataagtaaaactgatcaacctctagccaaagtgatcagaaaaaaaagaaataagatacaattacccaaataaggaatgggagaggtgacatcactatagattctgtagatatgacggataaggtaatgttgtaaacaactatggtagatagcctctaagatgttcttcgatgattcccacctccttgtagtcacactcctatgaagtcctctctccttgagtatgaggtgaacttactaacttgctttttagtgagatgtcgcttttggcattagttcacaaaaactgtggcttccaccttagagctctctcattgtcccactaactcccactctgtgggaggccagctgttgtgttataagctgtcctgtaaagaggcccccattggcaaggaactgatgtttccagcctgcagccagcaagtacctggggcttgctaacagccatgtcagtgaactttgaaacaggtgacaccttgactgtattgttgtgacaccttgactgtattcttatgtgaaaacctgagccacaggcacccaactaagctgtgacttagaaatattaccagttcaacttcaaactcttctaaaaaaactgaaaataaagaagtaattcccaactcattctatgagggcagtattaccctgatttcaaaattgaataggaaaaagaagaaggagaaggagaagaaggagaaggagaaggaagaggaggaggagaaggagaaggaggaggaggaggaggaggagaagaaggagaaggagaagaagaagaagaagaggaagaggaagaggaggaagaagaagaagaagaagggaggaggaaagctataggctaatatgtcctataaacatagattcaaaattttaaacaaaattttaacaaattgagtatcaccaaatgttaaaaagagaatacatcattgtgacaacgtgaggtttatccctggaatgtaagctttgtttaatatctaaagattgatcaataactcatgacatttaccaactaaaaaagaaaactatatgatcatctcagtagatacagaaaaatttttgacaaacttcaacatcaatttctgataaagtctcaacaaacagcatagaacagaacttcctccccattgcgcagcacagctgctgtggcagattgtggccagactgcttctttaagtgggaccccgatccatcccccctcactgggcaggacctccttgtgagaatttcagcaactccagccagggttttatggacagaactctgatctctctgggacagagcccctcaggggaagggtggccacagtctctgtggttcagccaacttagcctttcctgcctgctggctctggagagtctgggcagtctggacaaaaggggatccccccagtgcagtgcacccagtcccccaaggggcagccagactgcttcttgaggcaggtccctgatcccattcctcctgactgggtgagaactcccaaagggatccccagacacctcttacaggagtgtttgggccagcgtcagtttggagcaggcagccatctttgctgttttgcaccctttgctggtgatagtgatacctccaggtgcagaagggacccaggtgattagggtctggggtggaccactagcaaaccacagcagccctgcagaagaggagcctgactgttaaaagaaaaacaaagcagcaacaacaacataaacaaaaaagatccccaaaaaaacccattgaaaggtcagcaacctcaaagactgaaggtagataagcccacaaagataagaaagaatcaatgcaaaaatgctgaaaactcaaaaagccagagtgcctcttctccaaatgattgtaatacctctccagcaagggcacagaactgggctgagactgagatggctgaattgacagaagtagccttcagaatgagggtaataacgaactttgctgagctaaaggaacatgttctaacccaatgcaaagaagctaagaatcatgataaaacattacaggagctgataaccagaatagccagtttagagaggaacataaaacacctaatggagctgagaatcacaacgtgagaacgtcacaatccaatcactagtgtctatagctgagtagaccaagcagcagaaagaatctcagagcttgaaaactgtctttctgaaataagacaggcagacaagaatagagaaaaaagaatgaaaacaaacaaaacctccaagaaatatgggattacgtaaaaagaccaaacctacaactgattggagtacctgaaagagatggggagaatggaaccaaattggaaaacatacttcataatgtcatccaggagaacctcgccaatctagcaagacaggccaacattcaaattcaggaaatgtggagaaccccagtaagatactccacaagaagatcaaccccaaaacacataatcatcagattacccaaggtcaaaatgaaagaaaaaatgttaagggcagccagagagaaaggccaggtcatctacaaagggaagcccatcagactaacagtggacctctcagcagaaatcctagaagccaaagaaactggaggccaatattcaacaatttttttattttttgtttttttgagactgagtctcgctctgtcacccaggctggagtgcagtggcgcgatctcagctcactgcaagctccgcctcccgggttcacgccattctcctgcctcagcctcccgaatagctgggactacaggcgcccgccaccgcgcccagctaattttttgtatttttagtagagacggggtttcactgtgttagctaggatggtctcgatctcctgacctcgtgatctgcccacctcggcctcccaaagtgctgggattacaggcgtgagccactgcgcccggcctcaacattcttaaagaaaagaatttccaacccagaatttcatatcaggccaaattaagcttcataagtgaagaagaaataagatccttttcagacaagcaaatgctgagggaattgttacaaccaggactgccctgcaagtgctcctgcaggaagcactaaatatggaaagaaaaaacttaccagccaccacaaaaacacactgaagtacacagaccagtgacactatgaaggaaccacataagcaagttggcaaaataaacagctagcgtcatgatgacaggatcaaattcacacataacaacactaaccttaaatgtaaatgggctaaatgcccccattaaaagacagagaatggcaagctggccaaagagcaaagacccgtcagcatcagcaaacacccagatgctgtcttccagagacccatctcaagtgcagagacacacataggttcaaaataaaggaatggaggaaaatttaccaagcaaacggaaaacagaaaaaagcaagggttgcagtcctagtttctgacaaaacagactttaaaccaacaaagataaaatagacaagggcattccataatggtaaaaggctcaattcaacaagtagcgctaagtatcctaaatacatatgcacctaatatgggaacaaccagactcataaagcaagttcttagagccctacaaagagacttagactcccacacaataatagtgaaagactttaacactccactgacaatattagacagatcattgagacagaaaattaacaaagatattcaggacctgaactaaactctagattgaatggacctgatagttatctacagaactctccacccaaaaacaacagaatatacattcttttcatagccacatggcactctaaaattgatcatataatcagaagtaaaacactcctcagcaaatgcaaaagaactgaaatcataacaaacagtctctccaaccacagcacaatcaaattagaactcaagaataagaaattcactcaaaaccatacaactacatggaaatgaacaacctgctcctgaatgactcctgggtgaataatgaaattaaggcagaaatcaagaagttccttgaaactagtgacaacaaagagacagtgtaccagaatctctgggacacagcgaaagctgtgttgagagaaatttatagcactaaatgcccacatcaaaaagctagaaagatctcaaatcaacaacctaacatcacaactaaaaaaactagacaaccaagagcaaacaaatcccaaagctagcagaagacaagaaataaccaagattggagtggaactgaaggagatagagacacaaaaaaaaatttcaaaaaaccaacaaatccaggagctgattttttttgaaaaaaaaaaagttaataaaatagactgttacctaaactaataaagaagaaagagaagaatcaaatagacacaatgacaaatgataggggggatatcaccactgacctcacagatacaaacaaccatcagagaatgctataaacacctctatgcacataaactagaaaatctagaaggaatgggtaaattcctgggcacaaacacttgcccaagactgaaccaggaagaaattgaatccctgaatagaccaataatgagttctgaaattcaggcagtaacaaatagcctagcaaccaaaaaaagcccaggaacagacgaatttacagctaaattctaccagaggtacaaagaggagctggtaccatttcttctgacactatttcaaacaattgaaaaggagggactcctccctaactcattctatgagaccaacatcatcctgataccaaaacctggcagagacacaataaaaaaacaaaacctcggacaaatatccctgatgaacatcaatacaaaaatcctcaataaaatactggcaaaccaaatccagcagcacatcaaaaagcttatccaccacgatcaagttgacttcatccctgagattcaaggttggttcaacatatgcaaatcaataaacgtaactcatcacataaaccacatgattatctcgatagacacagaaaaggcctttgataaagttcaacatctcttcaataaactctcaataaactaagtattgaggaatatacctaaaaataacaagaaccatctatgacaaacccacagccagtatcatactaagtaggcaaaagctggaagcattccccctgaaaactggcacaagacaaggatggcgtctctcaccacttttattcaacctagtattggaagttctggccagggcaatcaggcaagagaaagaaataaagtgtatctaaataggaagagaagaagtcaaactgtctttgtttgcagatgacatgatcctatgtctagaaaaccccatcgtctcagcccaaaaccttcttaagctgataagcaacttcagcaaagtctcaggatacaaaatcaatgtgcaaaaattgctaacattcctataaaccaacaacaggcaagcagagagccaaatcatgaatgaactcccattcacagttgctacaaagaataaaatacctaggaatacagctaacaagggaagtgcagggcctcttcaaggagaactgcaaaccactgctcaaggaaatcagagaggacacaagcaaatggaaaaacatttcatgctcatggataggtagaatcaatattgtgaaaatggccatatggcccaaagaaatttatagattgaatgctattcctattaaactaccattgacattcttcacagaattagaaaaaactattataaaattcatatggaaccaaaaaacagccccaatagccccaatatctttttgcttaggattctaagcaaaaagaataaagctggaggcatcatgctacctgacatcagactgtagtacaagactacggtaaacaaaacctcatggtactggtacaaaaacagatacatagaccaatggaacagaatagagaactcagaaataagaccacacacctacaaacatctgatattcaacaaatctgacaaaaatgagcaatggggaaaggactccctatttaataaatggtgctgcaaaaactggctagccatatgtagaaaattgaaagtggaccccttccttacaccgtatacaaaaattaactcaagatggattaaagacttaaatgtaaaacccaaaactgtaaaatccctagacgaaaatctaggcaataccattcaggacatagacatttcatgacgaaaatgccaaaagcaattgcaacaaaaccaaaaattggcaaatggggtctaattaaagagcttctgcacagcaaaagaaactgtcatcagagtgaacagacaacctgcagaatgggagaaaatttttgcaatctatccatctgacaaaggtataatatccagaatctacaaggaacttcaacaaatttacaagaaaaaaataaccccattaaaaagtgggcaaagggcatgaacagtcacttctcaaaagaagacatacatgcagccagcaaacatgaaaaaaagctcaacatcacagatcataagagaaatgcaaatcaaaaccacaataagaggtgggtgggtcacttgaggtcaggagttcaagactagatctagaatcagaaataccatttgacccagcagtcttattacggggtatatacccaggaatataaatcattctattataaagatacatgcatgcataacttcactgcaggactattcacaataacagagacatggaatgaacccaaatgcccatcaatgatagactggataaagaaaatgtggtacatatataccgtggaatactatgcagccataaaaaggaataagatcatgtcctttgcagggacctggatggagcaaactaatgcaggaacagaaaaccaaacactgcatgttctcacttataagtgggagctgaactatgagaacacatagacacatatggggagaacaacacacactggggcctgttggggaaggttgggggagggagagcataaggaagaacaactaatggatgctgggcttaatacctaggtgatgggttgatctgtgcagcaaaccacctggcacatgtttacctatgtaacaaacctgcacaggtaccctggaacttaaaagttaaaaaaattttaaaaagaagagaacttcctcaacctgataatgtgcatctataaaaaaacctatacctaacatcatttttaatggtaaaagaccgaatcctttcccattaggatcagaaagaagacaagatatccactctcacgacttctattcaacactggaggttttagccagtgcaataaggtaagaaaaataaacaaaagtcacctactttttaaaaaaagtaagaatgaaaatatttttaccctcagatgacctgatcacctatgtagaaaatccagtgaaacatttaaaaggaagaaacagggcaggcatggtagctcacccacccaaagtgtaatcccaccactttgggaagctgagacagaaggatcacttgaggtcaggagttcaaaaccagcctgggcacagagtgagaccttgtctctataaaaaattaaaaaattagctgggcatggtggtgcatagctttagacccaaacacttagaaggctgaggtgggaggattgcttgaatccaggagcttgaggctacagtgagctaagattgtgccactgcactccaaactgggtgacagagccagaccctatctctaaacaaaacaaaactactagaactaatacatgagtttagcaaggttgcaggatacaagatcaatgtacaacactcaactgtatttccatatactaacaacaaataattgaaaaagtgaaattaaaagcaataccatttacaacagcatcaaatagatgaaatatttagggataacctaacaaacaatgtgaaatgcctgtacactgaaaactttaaaacattgctaagagaatttttaaaaatctaaataaatggagatacattgtgttgctgggttggaagactcaatattgtttaaatgtcagttcttccctagttgatttatagacttaatccaataacagtcacatttcctttttttgtataaattgacaaactgattataaaattcatgtgaaaatatgaaggacctagaatagacaaaacaacttttaaaaagaatgaagttggaagactaggaccacctgatttcaagacatattacaaaactaacagtaatgcagacagtttggtactgggcaaggatagacatattcatcaacagaacagaatagactacagaaataaatccacatgtatatggtcaactgattttcaacaaaggtacaaaggcaattcagtggagaagggacagtcttttcagcaaatactgctggaacaaatgtatatccatatgcaaaaatgaactttgatctagctacatgttacaccatattaagaaattaactcaaaatggatcacagacctatttataaaacctaaacctgtaaagtttataaaagaaaacatataagaaaaattttgtgaccttggaataagcaaatatttcttaggtacaataccaaaagcatggtccataaaagaaaacactgatgaattagactttttaatcattaagaacatcttctctttcaaagagaatcttaagagaatgagaaaaagccacagactagaataaaatatttgaaatcatatatctggctgggtgtggtggctcacgcctgtaatcccagcactttaggaggttgaggtgggtggatcacctgaggtcaggagttcaagaccagcctggccaacatggtgaaaccccgtctctactaaaaatacaaaaaaaaatgagccatgcgtggtggaggcacctgtaatcgtagctactcaggaggctgaggcaggagaattgcttgaactcaggaagcagaggttgcagtgagccaagattgctccattgcactccagcctgggtgacaacagtgaaactccatctcaaaaaaaaaagaaaaaaaaaaactctaaaaacgcaatacagtggtgctcccttatctgtggttttgctttccatggtttcagttacctgtggtcaaccatggcctgaaaatattaaatggaatattccagaaataaccaattcataggttttaaattgtacacctttctgaggagcatggtgaaatctcatgctgttccactctggcccacccaggacacaaatactccttttgtccaacatatccatgccatatacactacctgcctgttagtctcttagtagccatcttgattatcagattgcctgtcatggtattgaagtgctttgtgttcaagtaacccttattttgcggtggccccaaagttcaagagtaatgatgctgacatattgttataatttggtatggtttggctctgtgtccccacccaaatctcatctcaaattgtaatcctcacatgtcaagggagggacctggtggaaggtgattgggtgatgggggcagtttccctcatgctgttctcatgatagtgagggagttctcacaagatctggttgtttgttaagtgtctggccctttcccctgcacactctctctctcctgccaccttgtgaaagtgtgtcttgcttcccctttgcctttcgccattattgtaagtttcctgaggcctccccagccatgcagaactgtgagtcaattaaacctgtttttctttataaattattcagtctcatgtagtacctttatagcagtgtgagaacagactaatacataattgttttattattagttatggttgccaatcccttactgtgcctaatttataaattaaactttattataggtatatatgtataagaaaaatcagtatatatggggctcagtactatccatggtttcaggcatccactgggggtcttggaatgtatcccccctcagataagggggactattgtaataagaaaacaattcaatattttaaaatgggtaaaagatttcaacagatacttcaccaaagaagatatatggatgacaaataagcatatgaaaagatgtccaataccattactcattaaggaaatgcaaattaaaactacattaaaataccactacacactcattagaatggctaaaattaaaaagactgagtaaatcccatgttggcacacactgctgaggagaacataatttggtccaaccacttcactttggaaggcagtctgggagattatttatttatttattccattcctggctgattttttttatagaaatagagtttcactatgttcctcaggttggtctcaaactcctgggctgaagcaatctgcctgtcttggcctctcaaagtgctagcattgcaggcatgagccaccgcgcccggccatggcagtttctttaaaagttcagcatatacctatgatgtgatctagctatgccactcttaggtttttacccaagagaaatgaaactgcatgtccatacaaagacttgtacgccaatgttcatagcaactttctttgtaatagccaaaaactggaaatagcacaaatacccattagcaagtgaatggctaaacaaattgtagtatatccatacaatagaatcctgctcagcaatttaaaacatgaattattgatacttggaagaacaaagatgaatctcaaaataattacactgaatgaaagaagccaggcaaaatgactacatgctatgtaaatccaattccacaaagttctataaaactaaactaatctattgttaactaatctgtagtgacagaagcagatcagtcgttgcctgtggatgagtagggttggcaaagagtcaggaaaggaggatgacaaaggggcatgtggaagctttttggggtgatggatatgtttataccttgattatggtatttcacaggtgcatacatatatcaaaacttatcaaatcatgtactttaaatatgtatgtcatgcactttaaattgtgtgccagttataccttaataaagctagtaaaactattatacattcttatttttctgagcaggttctcatggagaacaaaatacaccatacctagtgttcgttttcttttttttaattaattaattaattgatttttattagtgttcatttcaaaggaccttgctaggtgtcctaaaacctatctgatgactttgcctgatactgatgattttattatgattttaaaaaatatttttagtagagacgggttttcgccatgttgggcaggctggtctcgaactcctgacctcaagtgatcttcccacctcagcctcccaaagtgctgggattacaggagtgagccaccatgctcagccaatactaataattgatatgggagaatgttttgtttttcctagattcctcatgcagcttaataaggaccataataacttaactcttagaacaaaggagatatttcaggcccaaagggaagcacatctggtgcctcctctgaaattcacaaaataagggcgttgttgtaagttctgcatgaagctaaacttgttcaaagtttataagttcaaaagtaaataaaaggactatcttttattctgagaccttatttcaatatcacttgtgataatgattatagatcgtagctgttatttacatattgctacttctcagggttaaaggtggcatttccacagcagtatctgggattttattgcctatgaaatcaagaaggtagagtaacaagaattgtgtagggtatgagcttttaccttacatgcaagttaacaagttagcctggtaatgtttgatggatgttagctaaagacatgagactcttgggtcagagaaaaaacacttgattactcatggcaaaagcagtaatcagaacttaatattgagcttttactggtttccatgccccacgtgccatgaggggaatgaaagtcccataatggatgtttatggatgtttgcacacacacagtgggctaccatttaaggagaggaatcctgagcctggtaagtccactgcttttatagtgagttgtaacaagcctgttctttgtctaggggaagatgttacctgatccctcaaggttgctcattacaaacacaaccctgagaaatggcctggataaagagcagtcagagccttgcttcttggcatacctgacaagaatgcacagagctgctcagggcccctggtaggtttgcctcccacactagggactgtgcatggaggcacctgccacttctgcctgcatcctgggctagcgtgacagtcagagacacagacaccagtgaatggctgaaatatgttcctgtggtcttctcactccactacaacttccttcccagttagggtccccatgcaggccctttgagctgcacctggcagagttgagttacatactttcatgtaccctgctgagtttgtcttctttgccttcagaaattccaacatactacatgagtcatggttcttggtattattgttatacccttctcagaatctctctgactccccagatttcacatcgttttccatttttgtaaaaggcctcaaggtctccatgctatggagaagagttatactcatcttttctttattcttgcattcctgaaagccttacattagcatccaagtgaggtttctctatcaatatcaacagtaaatatttagtgaactaaacacctactatgctcagcataatgtataaaatatgatttaagggttcctgggagcttcaaatgcatcacctgggtgcaaaaacatgaggaaaccaaaaagtacattctggtggtttttttaatagcatttaaaaaataatgccttgctgcagggataggagctgtgctgctttcatatcaattctgttctctttgtggtttgagaaactggagctgaagggaaggtgattgggaataaaagaaagcagtactgatttttctggctaaaagaaagtttgcacactgtcatgcactattagaatttctgggatcttctttataatccccggtttgatggttattggccaagaaggaagaaggggagctagtcaggcctagaataattaccagccatacagcataatctggggctagtgttgcagggtcaaggactgaatgaggcagagtgaccaggagcagatcctgcaaggccttgaccaaaaaggaagctaaggttcatagaaggaaaatattgtattgatcatcaattctagaggattgggcatagagccaaaaataggaggtgtatcatgagatcaaaagccattggtggccaagcgcgatggctcacacctataatcccagcactttgggaggccaaggcgagcagatcacttgaggccaggagttcaagaccagcctggccaacatggcaaaaccctgtctctaccaaaaatataaaaattagctggccatggtggcacatgcatgtaatcccagtactcaggaggctgaggcaggagaatcacttgaacctgggaggcggaggttgcagtgagccgagatcatgccactgtactccaacctgagtgacagagtgagaccctgtctcaaaaaaaaaaaaagccactggtatgtaggaatggtgcaggaaaaaagtgcaaagcagaaatgaggtgaaaatatatagaactatgaacaggaatgaggtctttcttgagtactggctgccagatggagtacgagtgggtcagcagaagttaatgaggtaggttaaaagttaatgcataggaatagtttctgcacagtcttctgatgctgtccatcctgcagtcaggcctatatcaatatcagccctagatgaagtggtcacaccctcctttgtgcacctactgttacaaatagtcatggctgtcattactccatcacagctgatggcacttactaggttgagagaagcggggctctgtctcccttaccatacagtgagctccttgagtttattcatctttgtgtttccattgtgcctggactgcgcactgtttcccgaatgaacaaattaactggcctagaatatatctatgatgataaaggtcagttcttagattattgttttcattctttaactgtttaagataatgtcaactctatgtaaaaattgtgccctaggtaagcagttgctttttattattattctctctctttcttgatggttactccctctaggagcccaaagcatgacgtccagagccccagattcccagccatcctggttgtgacccttcattctcaactttcatttcaatcttagtatgccatgaaaagccgtctgcttttgaagcactatcagccacagagttctgtacttttagaaggccttctcatagtcagattctcacaaatatacctattgtttcaataaatatttattgaattggccagcaatgtttcagatactgttctaggtgctggggttacatcaaagaacaaggtaggcaaaatcactaccctcgtggactttgctttcctggagggggaataggcaggacataaaataaattgtaaactattcgggatgttagtgatcagagaagaaaagtaaaacagggacagtgaatggggactgtcagagtggtagttgctattcaagatcatttgaccaaggaaggcctcgctgaggaagtaacatttgagaatagacttgaaaggcataaaaaaacaagtcattaggtaaaaaccattccaggcagaaggaacaaataatgcaaagggccagggatggaaacatctgtagtgttcaggggaaagcaaggaggccagtgtgactggagcagagtagattaggcaaagaacaggagtagataagatcagcaaggtaatgggtgccacatcacgtaaggtcacacaggacagtgtaatgactttggcttttactctgttatggggagccattgcaggattgggagctgtgaaatggcacaccttgcttacatctaataggaaatctgctgctgcattgagaatagacctttaaattttaaaagagatatctatggcattaccttaaataaagtcatgctccttggagtgcctcaattcatgtacattaatgggtaaaagtggaattcaagaaaccctggaaatgtatgggggagtcctctttgtttctcctctgctcatgtctggtgggtgagcactaacgccatctcttcctaagcgagggctccctagcagagcaccgtgcacatggattcttcctatgctctgcattctttgccacagggatgccataatttggcaatatgcagtagagactgcctcaagaggcagttcccttctttatctaagccaagagaaatttggttctgcaagtaacaagtaattactgctgatgacattccttgtacacacttgaagagagcgtggaccgcaaaataaaaactggagcaaaaagggactatcagataatccagattaaagattggaaaggaggaaaacacattatttacacatacaacacttgattttatgagtagagaacacaacttatgtgtatgtacgttgtacacttgattatatgtgtagagaattcaaaagtgttcagataaattatttagacttaaaaagagacaaataattttgggaaggtgatagtggcagtagtagcataggttttagatattcctgaatctccacataaaaacagcaactagatagaagacacaaaactcatgggcaacaaaataaaatccatttacaagaaaattagatgatgaggtattcttatgatcctcaaaatataaccggttggggaaagaccacccacagccacaagagctgtgttatttgtgtctacgtaggagaaataagagagaggcaatggacatctgacagacctgagaacagagaactcaaaatagcccaaaggtattcactggaaagcatgggtggggcaatttgagatcagcagctgaaacttaataaggggtgagtgcaagggatccacctctggaaggtctaaaaggaatgcagcagtctagctgctgtgaaatttctagactgatctggtggggctcccttccaagataggatctcatgaagaagagaaactgtggggagtattgagctcaaaattgagcagaatgaagacaatacagatgaagaaggaagaggaatatccaaatgaaagcatatcagagtcaggaaatctccttggaaagcaagccagagtattttttaacaccatattaatacaatatagcaaaggaaccatgtgaagttagaaaagctatctgaaccaaatgtctttttaaaatcacataaaaactaaattcacacccacaaaaatctacagcaggaaaatatcaaggccaaatccaacacaacattattaacctaagaaagagaataaggggaatatctgcagacaatgaaagcatgccaaaaagatatgattgaaaatagattgagaccctaatgtactatttcaggtgcattcaaagacattgaagaagtcatataagacatagaaaagcaacataaatcaaattaggaagctcagaaatgagacaattcaagaaaaaattagaaataaacatctaaaaatgaaggctgatctagaaggaactcaacaacaaatgaatacaacataattctttaacataaataaaaggtagaaaggaagaaaattttttaaatggaatgaaaaaagatttttaaaaagttttgaaagaaaacaacaaatattgaaaataggcaaaaaagatcaatttatcaataataagagtccctgaaaaagaaaataaaagcaaggaaagaaaacaagtataaaacaaacaaaaccctctaatttaagaaaactgaaaatttgaaactacgtatggaaagaacacactgtgtacttgagtatatcataatgactaagttcagcagagttgttggatgaaaggtctatgtgtaaacaccattttatgtaacatttaaacaaattttttagatcatttaaaacagcataaaaaatataaaatcctatttgtgacggctttctagtgtgtcaacttgactaggccaaactacatttcctagaattctctttcttgtatgttttctgaccacaaaggagattctttctagatttggaaagctaagggaagttccagccatcttatagcacacacattgttgcgaacctgctgatccacctactggggtgaagcagagctggacatgcaattgctctaccttcccctggaccctccattaacttgtcaggcccctgggccaggtgtgtgtgattagctccacgacaaagggccacagcttctgcaggatatactcattacctagatcagaggcaacaataactgacatgggtttcagtctcttcacaggggtgtgagcatgctctaatctcttgattttccctcctgactgcctgccttgtagacttcaagctctagcatcagatgtggagacaacagccttacagagactgcttaaagagctcccaaaattgcataactcaactgcctgtgacacatccatatatctctttttgaatcctggctaatacagtaggaaaagatatgcattatctctatatagaaaatcataaaatattttgagaggaattaaattctatattcattgatcagaagacttaatattgtaaaaatatcatttctccccagattgatatataggttcaatgcaatagaaattccaacaacttgcatatgtgtgtgtgaaacttgacaagctaaatctcaaatttatacggaaattcaaagggctaaaaataggctggaaagaaaaggacaagctgggcgcggtggctcacgcctgtaatcccagcacttttggaggccaaggcgggcagatcacatgaggtcgggagttcgagaccagcctggccaacatggcgaaacaccctctctactaaaaatacaaaaatttgccgggcatggtggggggcgcttgtaatcctagctacttaggaggctgaggcaggagaatcacttgaacccaggaggcagaggttgcagtaagccaagatggcaccattgcactccagcctggatgataagagtgaaactctgtctaaaaaaaaaaaaaaaaaataggacaaagtgagaggatttcttcttctggatatcaatatttactataaagctagtaattaaaacctgctaaatatggtattggagcaaggagagacaaatagatcaatagaacagaatagagagaatccagaaagagtcaaggatatatagatgcttttcaataaatggtgcagggtcagttggctatccacatggagaaaaaagtgcaacctgaatccacctcaacaaaattacttccaggtgaactactgaaatggaaaacaaaaaaacttcaggaaagtcatagaagagagtatctttatgaactagggacatgaaaatatgttaaacagaacacaacaagtattattcataagggaaaatattgttaaattgctctacattcgttcaggagcagcctgggcaacatggcaaaatgccgtctctgctaaaaatacaaaaatacagccaggcatcgtggtgcatgcctgtggtcccagctactctagaggctgaggtgggaggatcactggagcctgggaggcagaggtcacagtgagctgagatcacgccattgcactccagcctgggtgggtgacagaggaagaccctgtctaaattgaaaaaaaaaaaaaagctctacattagaaattgagaacttctgttcattaaggacatcactaaggaaaaaggcaagccatagactgggacaatgtattcacaatgcatatgtcatcaaagaatctttattcagaataaaaaagtgggaatctatatgaaaacatagaaaatccacttttttaaaaatgtgcagtcttatgtttatcacagcactgttcacagtagtaaagtcatagaatccatctaagtgtccatcaacagatgattggattaaaatgtggtatatttttgccatggaatactatacacctataaaaataaatgaaattatgtcttttgcagcaatgtggatggaactggaagccattatgcttactgaaatgactcagaaacagaaaatcaaaaaccacatgttctgattgataagtgggagctaaacagtgggtatacacggacatacaaggggcataatagacactggagactccaaatggtgggaggatgggagtgggtgagggatgaaataccacctttcaagtacagttcaggtgattggtacacttaatgcccagatttcaccactgtgtaatatatccatgtaacagaactgcatttgtatccctaaatccataaaaataaaaaaatttaatttcaaaaaataaaaaatgtgcaaaagatatgaacaggtacatcacaaaagaacaaatccagatagccaataaacaaatgaaaaagggctcaacttcattagtcatcagagaaatgcaaattaaagccacagtgtgataatactacatactcacttgaatgtctgcaattaaaaaaaagactgacaaaaccaagtgttgagaaggatgtagaacaactggaattctcatgcatagtgtggaagtgtgcattgatacaatcacttttgaaaactgtttagcagtatctactaaacttgaacatattcataccctgtgtcctagcaattccagcaaaattgcatacatatattcaccaaaataatgcactagaatattcatagcaacactatttgtaataggcccaaattgtaaactgtttgaatgtccatcaacagttataatatctatttataatgtccaatatatcacagtatactccatgccacaatatagatggctctcacaaaaataataaatagtgttgagcaaaggaagccagaaaaagagattataccctatgttactctttttacatgatgcacaaaaacaggcagagctaatctaagatgttagaagtcagattgggtgggtggagaaaagggagaatagagcaagaggaagacttctgaagcactaataatatgttttttgacttgcatgctggttgcccaggtgtgtcagtttttgaaaattcagtgaattatacatttatatatatgcatttttgtttatgcatatttttcttcagcaaaagtttaaaaaataatctttgggcttcctgaaaagataaaaaggaaacgtttaaaggatacatgtcaattttttagcagagacaaaatttttaaatactattttctgaaaaaaaattctccctcacagctttatatttattattaatattgaaggatataatgaatagttttactgtaaatgcagaagtaaattttataagacttgtttatggcaccattaggaatagtttttaaaaatcagaacttgtgtttatcaaaagacactattaaatgacaccaaaagcacaagtaacaaaagaaaaatgtgtttaatatcatcaaaattaaaaatttctggccaggcaccgtggctcacgcctgtaatcccagtactttgggaggccgaggcaggcagatcacaaggtcaggagtttgagaccagcctgaccaacacggtgaaaccccatctctactaaaaatacaacaaattagccaggcattgtggtgcgcacctgtaatcccagctacttgggaggctgaggcaagagaatcgctcgaacccaggaggtggaggttgtagtgagcgagatcttgccactgcactccagcctgggtgacagagcaagactccacctcaaaaaaaaaaaaaaaaaaaaattctgtgcttcagataacaccattaagaaagtaaaaagaacctacagaatgaagaaaacgttttcaaattatataatagacctgataagggactcacatctagatatataaagaatgcttacaactcaataatacaaagacaaataaaacaatttttaagtgggcaaagaatctgaatagaagtatctcaaaaaagatatatgaatggccagtaggcacatcattacccctaagggaaatcaaaatcacaatgagttaccactttgcatcccctaagatggctataatataaaaattaacaagtgtttgtgaggctgtggagagattagaaccctcattcactcctcctagggatgtaaaatagtgtctgagctagggaaatagtttggcagtttcccaaaatgttaaacatagggttaccatatgactcagtgattaagctcctaggtatatactcaagaaaatcaaaacatatgtccatgtaaaaacttgtacatgaatattgatagcagcattgtttataatatccctaaaaggaaacaacccaaacatgtatcaactattgaatggataagtgaaatgtgttatatccatacagtgaaatattattcagcaattaaagtgacacactgactcatgctaggacatggatgaaacttgaaaacatgatgttaggtgaaagaagctagtcgcaaaagatcacatttgattccatttatatgaaatgaccaaaatagacaaatctatagggacagaaaggagattcgtggttatatgtggctggggaaatgcaaattaaaactactaggagatacataccgatggtatgtatgcttatctttaaattatctttaaattttttaagataataagataaagatgtgaaactatgaaactctcatttactcactgggagggtataaactggtacaaccacattagaaaagaaattggcgtatcttttaagattaacaacacatataccttgagagccagcaaatccatttctaaattctactcagtagaactatgtgcatatttatatcaataggtgtacaaaaatattcatagcagcattattgtaatcacccaaatgttcatcagaagtataaggaataaataaattgtggtatattcctgcaatgggatattatatagcagctacagttacacccagcaacatgtataaatctcacaaacaacatcaaataaaaaagccaaccacaaagtagcatccactatgattcccatttatgaagtttaaaaacaggcataactcaactatagtattaaaagtcaatatagtagttcaccttaagggagaagggaaagagtaaaaagtataatatgaggtagaattttgaggtattgtaatgttctctttcttgggttatagttttctatatgatgttttctttgttacaatttactgagctatacatttttaatttgtacacttaaaaatacatttcctggccaggcgtggtggctcgtgcctgtaatcccagcactttgggaggctgaggcaggcagatcaggagattgagaccatcctggctaacacagtgaaaccctgtctctactaaaaatacacaacaaaaattagccaggcgtggtggcgggcacctgtagtcccagctactcaggaggctgaggcaggagaatggcgtgaacctaggaggcggagcttgcagtgagccgagattgcaccactgcacttcagcctgggtgacagagcaagattctttcaaaaaaaaaatatatatgtgtgtgtgtgtgtgtgtgtgtgtgtgtgtatgtgtgtgtgtgtgtgtctgtgtgtgtgtgtgtgtattctggcccaagattatagttttttttaaggcagtctgtcaggggtctacaattgtatgagttataaataaggagtgacaatatcttcagtgaactcctgaacatgaaaaccaagggtcgactgcgaataccttctttacatacaaccagacattatggaatgaatgtgttccccccaaattcatatgttgaagctctaactcccagtgtgtctgtatttggagatagggtctttggggaagtaattaaagttaaattaggtcatacaacctacagaattggagaaaatatttgcaaactgtgcatctgacaatggtctaatacccagcatctataagaaacttaaatttacaagaaaaaactaacaaccctatgaaaaagtgggcagagttaattttttcatgagcaatggaaaaaaattaaaaagtctgaaagcaggcaaagaacatgaacagacacttttcaaaagaagacatacatgcagccaacaggcatatgaaaaaaagcttagtatcactgatcattagagaaatgcaaatcaaaaccacaatgagataccatctcacaccaattggaatggctactattaaaaagtcaaaaaataacatgctggcaagatcgcagagaaaaatgaacacatacactgttggtaggagagtaaattagttcaacattgtggaaagcagtgtggcgactcctcaaagagctaaaaacagaactaccattcaccagcaattccatttgtggttgtatacccaaaggagtataaatcattctaccataaagacgcaggcacatgaatgttcattgcagcactattcacaatagtaaaggcatggaatcaacctaaatgcccatcaatggcagattggataaagaaaatgtggtacatatacaccatggaatactatgcagccataaaaaagaatgagatgatgtcttttgtttgaacatggatagagctagaggccattatccttagcaaaccaacacaggaacagaaaaccaaatactgcatgttctcacttataagtaggaactaaatgatgagaacacatggacacaaagagaggaaaaacacacactacacactacctgagggtggaagatgggaggagggagataattagaaaaaataactgttaagtcctaggcttagaacctgggtgacaaagtattctgaacaacaaaccccccgacacgagtttacctgtataacaaacctgcacatgtacccatgaacttcaaataaaagtctgtgtgttttttaaggcagaagtcagcccctaccttgaaagaactttctacatagatggctacagtgttactgagcgttttttttttggtctatcctgaatgtcatgggaaaacttttaaactgctctggatcaagattagtgcctgtggtatttcatttctcctactcaactgttgcagttacatgatcttagaaattctttttggcatattgatgactgttatcattcaagttacatcaagagagacttctttctatgaggagctattaagaccctcttttggacacatacacaacttcaatttacatctaagacaacttattttaatgaaattgcttatttgtttgctttagtccttagattatatgatcatttgggcagggactattctttgaatatttcctggcacatttttgtctcaataaagaggaaggtgaaggaagaaagaaaggaaaggaagaagggagggaggaaggcattcttgttttctatatcctaaacctataattttgtcaaaaaagaatattaaatttgcctaaaatgttaacaaaaaataggtcataatgatggggccctaattcaacagggctggtgtccctataagaggaagaggcattgaagtttgctctccctgcatgcacaaagagactatgtgaggacacagcaaaaggacagctgtctacaaaccaggaagaggcctcgccagaaatcagcccttgaaaaaacctgggtcttggactttttgcctccacaactgtgagaaaataaatttctgttgtttaagccacccagcctgtggtgttttgttatggcagcccgagcagactgatacaccagacattcactgtatccaactgtttcaccataatagcctttcttattttgatcaaattactgcatcaggatttgatcttaaatttcatgtttcctttgcttttgtaaatgtagctgagcatccaaatttcactcagtttggatgctaacaagattagacagttatctgacagtaatcagtgcctgatcctattctgtgtcttcttccatcaccatcccactaaagagcttgcattttttgtttcttttagccagatagtaaacatttttcaggcattttgaattttgccattgtaaatggtgaaagattctctctctctctctctctctctctctctctctctgtgtgtgtgtgtgtgtgtgtgtgtgtgtgtgtattaggagggggtggtgatcgggatgctaatctatgcacagtgacctttgtttctatctggctgagcagatgtaggaattaatcattgtcactcctggatggtgctgctgcagctgtcccccactgcctttctgcccctgatagatttattagtgtgttttgtttgctgaaaagcatgcctcagcacagaagaactggcaaattagagaagctttatctgtgagtataattttttggaaacatggttttttctacacatctgtacctatatactctgagctctttaaaaaaaaggaggaggaagagagcaaagaaagaaaaggaaaacaaacaggtaatattgtttctgtaacatcagaacgattatttcccagctgagaatgttcatactggaacagtgtcatggccatccaccttaggattgcagagaaccaattgttttctaacctctgtatttctttttgcaactgcccaccccctcacccacttaactgccaactatcagccagaattttggcatactttggctctaggcacaagaaaataagtggtctgggttacttagtgctaaatttattttatagtaggcgtcactacaaccttgagactgtaactaacactttctaggctccaagcaaccccactacgtagatatccctgcagcctcatcaaattcaacccgtggggatattgataccgtcctggatggaaatcagagtagccacacccctttcaatgttgggaatctgccaaacaattcagtataaatttcctgggcctgggctgtgtattttcattccaccccacccccaaatcagtcagcatgccctggggcagagactaaagagccgccagtgcctattcagagttggcttattcctttctgatggcccatcccctccccgaaatccaagaccttggccttagatatcttggctagcctgggcctttctggtaccacccttcactctctaggagctctgagaattttctgcacttcccgacgctgcttgatagagtgactcacagcttactctttcattgactctttctgtatttctcttcttcagaatttctcttctgctgctgcttttagacatccttgcatgttcagtccctaaatcaccactgcttgttattactttcatgttcccaacatctggcatatgggtcttaatcccatgggtccacccagactcatgaatttaaactcttctggtctaaactcttccaccaccatttgagcctcaattctgtgaacagttttgtctctaaaagccacataccttagtgtaagaaggcagattaatcctctgaatgtcaacttaacagttaggcctatctcccaagaaagagaaatgaaaactcctaattagtaatgactcattttgatcaaataatcaatttttggaccattttcttaaaactatattttattgcctgtaactatttcctggaggataataatcatccttaaattactatgtgttttgtgaagttggtgctttacttttcgtgtcctaaatatgcatatctgaatctttaaattgtagcttctctttcaagtgttctaggatttcatttgccatggttgggatctctttgtgatttgataggtttcgatcacatcctcactagccttctttccaagccacagaacggtctgtcttcattcagtagagaccctgccattctagttttctcgctggaatttgttttcccatatccttcttgagcaaaggtgactaaagccaaatgtttcattctggcactttgtgagacgtgggctttaagctctcaaaagaagagaaaatctcatagttttatatgagatatacaatgaacaatagtaaaatagaaatgttattggcaagaggagtttttctccaatatccatgagtaagaattccttggacacataagataacaagaggaatatacttactctgttttccttttgagatattctttacataccatgaagttttcctttctaaagtttgcaatttaatagtttttagtatattcacaagcttgggtaaccaccatcactatctaattccagaacatttttatcacctgcaaacaaaaccttgtacctgttagcagtctctcctcatttctctcttcctcccacacctggaaaccactagtctactttctatctctatagatttgcctattctggacatttcatataaatggaattattgaacatggggccctttgtgtctggcttttctcatttagcataatcttagcataatatttataaggtttccctgtgttgtagcataaagcgttacttcattccttttcatggctgaacatcccattatatggatattccacattttgtttatccattcatcagttgatgctatctgttgtttccactttgaggctcttaagaataatatgctgctgtgaacatttgtgtacaagttttttcatgaacatgtttttacttatctgggtatatacctaggagtggagttcctgggttatatggtgactgtttaacataagtgtagaactgtttttcaaagtgactatactatttcacaatcccaccaacaatgtatgagggttccagtttccctacatcatcactaacacttgttttattatctgcctttttaattctagccatcctagtgggtatctcattgtggttttgagtcgtatttcccttatgaccaatgatgctgagtgtctttttatgtacttattatccatttgcttatcttccctggagaactgtctattcaaatcctttgacatttaaaaaaattagattgtcttggggccgggtgcggtggctcatgcctgtaatcccagcactttgggaggctaaggcaggcagatcacctgaggtcaggagtttgagaccagcctggccacatgctgaaaccccatctctactaaaaatacaaaaattagctgggtattggtggcacatgcctgtaatcccagctactctggaggctgaggcaggagaatcacttgaacccaggagacggaggtttcagtcagccgagattgtgccactgcactccagcctgggcgacagagtgaggctctgtctcagaaaaataataaataaataaataaataaatattgtcttggaaatatacttaaattaattggcctatagtcccagctactcaggaggctgaggtgggaggattgcctgagcccaggagtttgatgtttcagtgagctatgattatgtcactgctctccagcctgggtgacagagtgagcccccatctctgaaaaaaaaaaggaagaaagaggaagaggaagaagaggaggaggagaaggagaagaagaaatgctcttaagtcaatagttctcaaacttggttcacattaaagtttcctaaaatcctgatgctcaggctttaccctaggccagttaaatgataatatcttggggtaggacccaggcaacagttttagaaacaaatctccagttgattctaatgtttgagagccattgctatagactacatgactaagctgatgataccaatataaaaatgttaaagatttgataatttagaaattatgccaggtattaaaaatgggagacttaactcaaatgtgaatcataaaatgcctaatcaggtcaaaagatagagttgagatttgtaataaagattgataaactttcctataataggaagtttcaaaccacctatagctagagaaaatgtctggctgtggttcttgcctagtgagcaggaattggttttatgaggtaaccatgggagagccaataaatgtgagtgatcatgacaattaaatctttaagcccagataatttatgtcaattattcaatgttcattaaggaaagtgaaaaaaaatgagtattagctaggagaaatggaaagggaggcttttgaaaggcataaaaagattggaggctattttaagagactttattggaagcatagaaaaagagtatctgagaatttttaaaaatccaatcacataaaaatgtgacagtcacagtggttattgtggagggaaaatgacatctctcaaagaatgtaaaaagctccccaagggagagcagggagcccacagagtgtattaggttaagtacaaaataggaaaaaagactttaagaaacactttcgaagagagtccaaaacacataaagggattatttaaaatctattaaaaggaagaagctagaataacagtgggatcttttgctgagaataagggggcacagggagtgctgaggcaccaaaagacaatagacaaactaattatgtgcctctgaatgtattgagaaagataccagagtgatagcacattcaaattgcctactacgaatggatcagtagtagttaattcaatggttttctgtgttttgcatatttcaagtcaggtaggcagaataaatactgattaatcactggaaactcttggtgtttatcttgagatttctgaaggcctccagaagaaatttttctcgtcttgcctctccctaaagccactgcccttgtcctccctctcctattaccaccaaggctcctaagtgtatagtctaccctagtcacctcactttctcatctccaattcattcttcaacccattcttctaactccattgaaaggtcattaaatctgactcattgccaaagtcattaaatcaacagatcgctttttagactaaattctttctagcctttagatatataacaccattaactgtttcttctgttcttcctttctgaaacctcttttcttaacatttattatatgtgaatgtcctggttttacctgtctacttcttgctagctaccttcactggctccagaattacttacgtatttctcttttttgttttttttttttaaggctagtcaagtgaagcagtgggaatggagaaggaacacagaaatctgtaactggttgtgatcaattaattgtagacactactgacttcagacaagccttacctatttaattttggtaacactctgggttccagtctcgattcacttcttacactatatccttcaccttgttttaacctctcctgtgacatatcctagtgctgcctctcttcccattttctaacttcatggttgatatagtcatatagatgtttcacagtttattctgatccagtaaccaaaaccagattaatatcttaccagcaaacttgctcttcctttgtgtaattcctgtcgtggttaatagcactaccatccacccgttctcattctggattcctttgtctccctacacatccggctagttaccaggttttagatatttaacctctgaaatgtctttcaaatctttctattgtccatctccattgcccaaccatagtcttcatttgtttttcatctggactattgcaatagtcccctaactcatcttgccgacattttcagctactgatctcttgccagcatttttttttccccaaacacaatctagttttaaaatacagacttctactgcctacataactccttaggtaagtatttaaggtcttttgtagtctggccctaacataaaatatccacttttccccttgaaattaagttgtgccctggtcgtacatgagaatggccattccttgagcacaccatgcacattcctcaccatgtctttgttcatgctcttccttgtttcacaactcttctcatttatcacctgacaaactcctatctatcctttaagacaaatttctgtctctcaaaatgtgggccctgggccagagcagcagtatcacctgggaacttgttagaatacaacttcttggggccccactttagactctgtttaatccaaaactttgtgtgataaggaccagcaatgtgaattttaacaagctcaccacatgattctgatgcattctaaaatttaagaaccactgttctagggaacaatttttttatcaatggccatagcactttacacatacctgtattacttactgcattatttaataaccatgtttacttattcacttatttatctggtctgctaagttgtgagtccccagagtcaaatacaatggtgctgtgttctgacacctgccatagtgtctagcacataacaagtgcttgataagaattcagcatactaaaatatacccccttccctccaggattcagtctagctagagtaaatagagagggcaagatcaaatggtgtccaaggcatctactcttaaaggtcgatatacaccacacaaaccaaaagcttacacactgacaataacaaatgtcagcaaagtaataaccaacgggtactaggcttaatacctgggtgataaaataatctgtacagcaaactccaatgatactaatttacctatgtaacaaatatacacttgtacccctgagcttaaaataaaagtttttaaaaaaataaataaagcaaatgtcagcaaggatgcagagaagctgaatctctcatacattgctgatgtacctactctggaagacactttagaagtttcttataaaattattccctcactgtgcgattcagcagtttcactcctgtgtatttaccgtagagaagtaactatgtatgttcacacaaaaagctgtatgcaaatgttttttagcagctttgtttgtaatagtcaaaaactggaaacattaacaatcaaaaaagaaatcaagaaaacaattccatttgtaatcgcatcaaaaaatgaaaacttgggaaaaaattttacctaaaagatgaaagacctatacactgaaaactataaaacactgatgaaataaatgaggaaggcacaaatcaatggaaagatatcccatattcatggattgaaaaaatttatattgttaaaatagccatactaccaaagcaatctacaaatgcaatgcaatcttaccaaaattctgatggtgtttttcacagaaatatgaaaaaaactaaaattcttatggaaccacaaaagaccccaaatagccaaaacaatcttcaccaataagaacaaagctggaggtatcaccctagcctatttaatttcaaaatctactataaagctatagtaatcaaaacagcatgatgctggcataaaaacagacaaaccaatggaacagaatagagagcccaaaaataaatccatccacttacagtcagttgatttttgacaaaagtaccaagaaaacacaaaagagaaaggacagcctcttcaataaatggtgttgggacaactatgtatccacatgcaaaagaatgaaattatgcctgttaccccagcactttggaaggccaaggtgggccgatcacttgaggtcaagagtggagaccagcctggccaacatggtgaaaccctgtctctattaaaaatacaaaaattagccaggtatggtggcatgcacctgtaatcccagctacttgggaggctgaggcaggagaatcatttggacccaggaggcagaggttgcagtgagctgagatcgcaccactgcactccagcctgggcaacagagagagaccctgtcttaaaaaaaaaaaaaaaaaaagaaattggacattggacccttataccatatacaaaaaatccactcaaaaatgaattaaaagcttaaatgtatgacctgatactgtaaaaactatcagaataaaacacaggagaaaagctcctgccattggtccgggcaatgattttttggttatggccccaaaagcacaggcaacaaaacaaaacatagacaaatgggattaaactaaaaagtttttgcacagcaatggaaacaataaacagagtgaagagacaacctacagaatgggagaaaatatttgcaaaccatacatctggtaaggggtaaatattcaaagactataaggaactcaaatcaatagcaagaaaacaaataatccaataaaaagtggacaaaggacctgaatagacacttctcaaaagaaaacatacaaatgtccagcaggtatatgaaaaaattctcacatcactgatcatcaagaaatgcaaattaaaaccatgagttattagctcatacctgttagaatggctcttatgaaaaagagagatagcaagagttggggaggatttggagaaaagggaaccctatacactatttgtgaggatgtaaattagtacaactattatggaaaacggtatggaggttcctcaaaaaattaaaaatagaactatcatataatcaagcaattctacttctgggtgtgtatctaaaggaaatgaaatcagtgtatgaaagagatacctgcactcccatgttcactgcaacattattcccaatagccaagatatggaaccaacctaagtgttcatttactaatgaatggataaagaaaatgtgagatatatatgtacacatacacacacacgatggagtactatttagtcttaaagaaggaaatcctggcatttgcaaaaacatggatgaacctggaagacattatgctaagtgaaataagcaagacatagaaaaacaaatactacatgatctcacttacatgtggaatctaaaaaagttgaactcatagaagcagagagtagaatggtagttgccacagactagggtggaggtggttgacagaaatggagagatgttggtcagatcaaagagcacaaagttccaggtaggacagataagttgtggagagctatacagtatagtgtctataattagtaataacgtgttgtatacttgaagaattccaagagagtatgtcttaaatgttctcaccataaaaaaagataagtatgtgcagtgatggatgttgattaaattgatttaataattttaattatttcacaatatatacaaatatcaaaataccatgttgtataccataaatatataatatttgtcaattctgccttaataaagctgggagaaaaaaactggaaacccaaatatccttcaacaggtgaatggataaactgtgggacatccatacaatggaatactatctagcaataaacatgggacaaagtattgatagatgcaacaacttggatggagctcaagggcatatgctgcgtgacagatgtcagtctcacaagcttacacactgtaagagtccagttctatacaacattcttaaaagacaaatttatagtgatggagaatgggttagtggttcctaggagttaggttggggaagcgtgtcactataaaggatagcatgagagagttgtgtttataagtgtgtatgtgtgatggaacagttcactatcctgattatgatggtggtttcgtgtggtgaatttcatagaaatctatatatgtgataaatttcataggactacacacacacacacacaaagtgcacataaaaactggtgaaatttaaatagagcctgtagtttatataatagtattgcactaatgtcaatttcctgattttgatcatgaactctggttatgtacgatgttattggggaaagctgggcgaaggatacacaggaactctctgtactgtttttgcaacctcttgtgagtcttaaataatttcaaaatgaaaagcttttgagaaaaataaagcacagggatttctgacaaaagctaaattagaaagcactgcttgacataatgctaaaacaggacccaggaagtggagagctcactgcctggtggaggtgggaaaggggtaaagggaagtggagattcttgccttgaagaacatttggtagaacgtgggccaggcctctcaaacaggtcactcctggcttggggaggagctaatactaaggtggaaagggaaatgaaagcttacttctcatcagcttcccatatggggaagggggccggaatctctcctcaataggcctccattttctcaatagggaaaacggagagaaggggaaaagggttcctctttaacaatggtcacaaaaggtgatgtgtgcagtgaaagattaaatggtataagaactcaggctctggaatcaaacccagcctcaaatccagtggcttgattttctattgaactttgctataccctgtttctctatttaaaaacaggggtaatgatactacttaactctgaaagctgattacattagattgtctatgtagagcacttagcaaccacctagcacatagataatcagtgttggctactctttttaatactattctatgccattaccaattttctaagacgtaacaataatacactcagatgattctgaccataatgtaatttttgattaaagtttcttcaggatccttcaatgcttccaactcataaattatatcagccctcagtccctatatatgtaaatacaatttaaattaaaatagttgttactttctattacatgtcttttatgtgctttgcactttaaatacactatttctaacctttatagcatgcaggataaatactattttccccattttcagatgaggaaactgcttcagagtggttaggcaaatctccaacatctataaacaacacagtaaacctaggcagtctgatggcaaagcccaagctctttccactacactgttacctcagtagtaatccataaaagatgcttaaacacatacatattgtctattagttgttctttttacatcacattacatgggcagactctacaactcctgccacagcctggcgcagacacttccaggccattgctgaagccagtggagacaccagacgatgacagaaaccaagaacccaaagctgattgtagcaagaattcagtctggagttcagtcagtagataaatccgagaggcatcatggaaattgtgccaaggtccaaggttcaagccagcagtcagaatctaaaggggcaggcaaaacccagcaggaggctctgcaggctctgtgccccccgggagattcatggcttcctctctgtctcctcttgttgacactgccggctataaatgggggctttgtggatcctcagttgaggaggcaggtgaaaattcttggcctaccagcactactacaggacgttagaaactagggcaggaagaccctgggtcttcattaatcagtgtgatgaaaacaggccccaggcagttgggtccactagtgggaagtgaaagaacactgaaggaaaccaggagtcaggacatctggatttgctgtcccaacatggtccctatctggcgataaaacagcatgcaaatttcttcatctaaaaatgaaggaatcaggtcagatcactgattttcaaactgtgttcctcagaacccaaggactccagtcctgctgtggagagataggtgggagcaagcaaggccttcctgtacagcacgcttcctttcatctcttccaagtactgaaccttctaattctaatgatttattcagcgtaacaggcatttaataagtttctactaggctcggggccttgtagaaggtgctgatggggacaaagctgagtaaaacccagtcccaacatcatgaattcctagattctggcttaatggggaaccattccagcagctgtcactgttcaggattcctctcagattccaagatacaccaaggcccggagttctgccacagaattgaagataagaaagagaggaaagaggccgagtgcagtggctcatgcctgtaatctcaccactttcggaggccgaggcaggcggatcacctggggtcaggagtttgagaccagcctgaccaacatggagaaaccctatctctactaaaaatacaaaataaattgggcatagtggtgcacacctgtaatctcagctactcgggagactgaggcaggagaatcgcttgaacctgggaggtggaggttgcggcgagccgagatcgcgccaccgcactccagcctgggcaacaagagcgaaactccgtctcaaaaaaaaaagaggaaagaggaatcttccccagtatggcaggcaatctttcctgcctcaaggagatcaatttacatgtcacctggaagcccataatattctgctttagcagtgactccttgtgattggatgtttcctatggccaattgtgcctgtgcttcatgccctacttaaaatcaggacatctgctctgcccttttggaagagctacaagtctcctgccaggaattgctcaaggccttttcctgcagctaaacggagaaaggaagttgaaatcattgcctcataaattacaacacatgccagggttgtaacctagagtctgaggttctaggcgaaaagaggattttgtgtgtgtgtctagtgttttccccacagcatttaaaagctcatctaaaatatattataattgcatgagatatggcaaaaatacattcagaaactaattttttgaagataaacaaacaaagcagaatgtgcccataatattcctaagtaaagccacacaaacttcctttccagtaagggtatcctttggggctttttccccctccttgtcaccaacttatcttgaatttatcactatgctttttcactattgttcctaaacttcagctgttatataatgagatagtgggcatttagtcttatatccaaatttccatatttcagcttttaaaatagttgcaaggatgcttttaaagttgatcctggccaggagaggtggctcactcctgtaatcccaactctttgggaggccaagatgggaggattgcttgagtccaggagtttgagaccagcctgggtaacaatgagaccttgtctctgcaaaaaaataaaaattaactgggtgtgatggcatgcacttgtagtgccagctacttgggaagctgaggtgggaggattgcttgagcccagtagataaatgttgcagtaagccaagatcatgccagtacactccagcctagattagagagtgaaactctgtctcagaaattaaattaaattaaattaaaaagttgatcctagcaaactaacaccggaacagaaaacccaacaccgcatgttctcactcataagtgggagttgaacaatgagaacacatggtcacagagaggggaacatcgcacaccgaggcctgttgggggttgggggcaaggggagggagagcattaggacaaatacttaatgcatgtggggcttaaaacctagatgatgggttgataggtgcagcaaaccaccatggcacatgtataactatgtaacaaacctgcacattctgcctatgtatcccagaacttaaagtaaaataaaaaaagaaagaaaaaaaaagttgatccttaggcctgtttatagtccaagggagctgtgaatgctgaaatttgtacactgtcaatttatatgtatattcacatattaatatctatagtacacatagattcaggaatgtagacttttgtcaaatggcctagtagatactgataaaacaacttctaatattaaattaaaattttattctattttaaagaaaaagaacaaataagaaaatcgtctttgcaatgaaaaggtcagaaaccaaggatgtggtgtcctaatatgctgatagcagagattatatctcctttgccttcctatcactggttcttaataccttggcaagttagtatttaggaattgttgaattaatgtttggcacatgaagatcattaaagcaataactcataaagcatggggaaaacaaggtcatttgctaaaggggaatttgggggcacgatatttagcaagtcttctttcacacttatagctaaatattttgtttatttgattatttgattgatttgggtgtaaattctattgcacctctggtaaaccaagtcagcctgcccttcctggttaagaaagagagacagaaatgcaaagtgtaaccagcttattaataagccgaggatagagaaaagaaatttgtctctgggctgggagcagtggctcatgcctgtaatcctagcactttgtgaggccgaggcaggcgggtcacttgagcccaggagtttgagatcagcctgttcaacatggtgaaaccccatctctactaaaattacaaatattaggcaaggatggtggcatgtgcctgtaatcccagctacttggggtggctgagacacgagaatcgcttgaacccgggaggtggaggttgcagtgagctgagatcgcctcactgcactccagcctggctgcactctagcctgggcaacagagtgagactttgtctaaaaaaaaacaaaaaacaactgtctctggcataacttgagaagggagaagctagaagagacctttggtttcatcaggtccaagcactgctaaccattcagctattctgtgggcagaatgtctttgttcttccaggtgcaacttcagcagctgtgggcctgaactgacagtgcggggtaaggatatcactctctccatgtgaaacaaagcaggactacaggaaagcaggctgatttggaaaggccaggcccacccaggacaagaggcagtgctgagtgtttggctcatgacaaaacataatttacaaatttactggcttcaaggatgtaaaaagttataatttactggcttcaagggtgtaaaaaggcctgcttcctagcctagctgcaagcagcaactcagtccatgatcagcagattttctgaagcctgggggtgggatgcatgttgttaacctctgatgcagatgtctgctgagagtctgtaatctgtgtggtcatgaagatgagatttcatccatcaattgcttgacaagggctatcatcgtatctctgggcctgcgtggctctcaacacacgacgtaagaaacatattggacaaaagcatttcctgggagaattctccagcaagaattcagccattggcaaagaatctttcaagtggccctatctcactggagacaagtaaacatatacgcagtgcatatgtgaatatacactccttcaaggtgctgcactttcctagaaacaaaaagaatgagaggaaaaagctttacaggcatcctgttaggatgctttctctcgtttatttttaggctcttttcagctctgtgctaagaggggaggcaaaggaagggcttacccagaatgcaaagctttttagtgagggtttggggtgtgcaaatttgttaaagtggtgaaaacccagtgtctatggaagttcacagcatccacagcactcagagccccccaaatatctctggcccttgtgttcactaattccaaggaattctcagccattccaggggactgtggggatccccctgaaaccactacaattacccagaatgtgcccctcctaacacataggcattgaaccagttcctaactctcccccaactctcacagatctctagtactttaagagccatatggcacacatgcttagccctcagccttctgcctaataggggagtgctttgccagggaaaaataagattagggaagaggacaaagaaagaagaagagaaggagtttccatatccattaatgaattcattcaacagatggttatggaacacttaccattttccaaagaccgtactatggtgtgggttatagaataagaaacagcctggcttttgaggagtagaaactgtccggtggaactaacattaaaaggtggtaatataacatgacaattgtactgatgcacatagaccctggggtgttttagggacatagaggatggcaccaaacctagactgagggcatcatccagacagatacatgctcttgtttctgtgagtcctgtgaggtgagtcactcacaaagaaaatgtaaagaaataactcagaataaataaaaagatagatggcacagtaagcttggcagattgatgttggagaacgtcagttttggtggcaacaatctgcaaggttgtctaattttctcctgcaccactcggctgcccggatgcaaaagcagacaatggattgtggctctgatctgagttttattgggcagatgctgcagaagggcttgtttgaaaagggaataggatgttattgagagaacagttcagatgaccaaccagggatctgaaattaggtagagacagtaagagagactgataaactatgaggaagcaaaagaaccaagtgactggaggtctataggctgtcaatgtacaaatgtggcaggagtaagcacatgagagggctggaggataggatgctcactcatttattcctcagatgtttattgagtgccttcagtgtccaggtagtgttctagttctgagagtacatcatgcacaatgctattgggaggagaaaacaataaataaaatcataataataaacaagtaaattatgtaatatgttaaaaggtaataagtactatggttggatgggggcaggggaagagaatagagcagaataagaattcagaattccgaggatagggtataattttaaatagggttgtcatcatagctctggttgagaaggtaacatatgaacacacaatcaggagagaaagaggatgagctatgcagatacatgtattgaaatattccaggcagagagaacagccacttcaaagcctcgcagtgtgtgagtgcctggtgttttcaaggaaaagcaaggaggctgtgtggctggagtggagtgggcctggagaagatgtaagaaatgaggtcaagaaacaacagggatcgagtgtgtaggctttgtagactctggtaaagactggctttccctctgggaaatagagagtcattgtggggttttgagcacagaagtgatgtgatcttatgtctctttaatggattactctagctgctatgttgaaaatagacttgagggaagtgccagggtagaagcagggagaccagttaggaggctattgcaataatccaaataagaaatgcaaagtaagactttgatcaggtggtggcagcagaggtggtgagaaggagttagattctggatgtatttcgaggatagagccaacaagatttatgacagattggatgtgggtagtgagcaagagtcaggatgactccaaggtttttggtccaggcaaattgaaaggtggagttgccattatctgaaatggggaagaaggtgagcaattgagagggagacttggagttaaattttgaacagattgtagtcaaattggtgttgggatattggtgtttacaattcctgaaggggaaccattctgagtgaccctaagacccagagtgtaacctggggatgggtgtctgaagaggaataaagtgaaatcattatgattgaataatttagaactctggaggctgaaaagctaatgaaatctcctaggatgttctacgaggatggtggcccaggcacgagagtagggaacggggtcaggccttatgatggatactttaaatacaaatagttagaggtcacactaatattagcttgaggtgtgcagaattttaattgggtgcagattagtgtatacattagaaataagcaagatattaaaagatcaaatttgctgaaacacatcagataacattatgataaaggtatttggagttttatttgagttagatttacaatcccattgtagcatggatcaaaaacagtaagttgataaagaaatcagataaattttcacaatttaaattttaattgttttattaaaaagcattttggaaagacattcatatttggttttggataggttaaagctcagtgataccatttacatcaatttttatagcattttagagagcatggtcttgtgacatcttaggataagttttctgttagtcacagcatgccaacaagtaccttgtgctccattctctggccatgttttcagactcagtaacttcaaataaaataaactgccaagttgagaaattaacatttgataaagtttttgcaacatcataccattgagctggtggatgtggcttaagcatctgaattcattagagactattgaaatgataatgcagaattatacaggttttgcagatgtagttcaatatttatctatatgtattgaaacctcacttgaggatagaaaaatcaagcaagttcttgtcttacatttccactcaataaatgaagaggaagagataatgagaaagctatataatcctttaaaaaaaaaattcaccttgtttctgactgacagtaacccaattcaggctttttactcttcataaatggaagacaagtaacctagatagtactggctatctataattaaatatacaatattgaaatctatttgctttgtggaaattatgtgtttgtggctgattaaaatattcagctatgtaggcttcatcttttagctcaatagaaaaatataaatgacattggtgactgaattcctaccaacgtggcaaagacattccccagacatacataattcacctgctgaattggagatgattcacctttcagtgacttcacaggtgttaacttggccaaacaaaaaagggaaatcatcttgtattcatcttttgttccctgaggcaagttttcagtaagattgctcgggaaaaatatcacaatatacatatataagtccatagtatgtctatttgaataatgaattagcaccactgtctgagaggtgaaaactattcaatgtatattttctggaaaataactaaattgagttcctcttaactaaatcagaaagagaaggaatcctcaatcaggatttcatgtagtactgtatcactcaaaggaaaactgattgtatagtggtactcaaataaagtgggtccaaagaaaaattatgagagaaacgtaccgatcagtgatctggaccaaacagacatgtggctgtgaaatccaggcagttgcttggtgacgaggtcaccatcagatagtcatggcttatgtgcaggaatgtgagaatggccatggggaggaatggcctgggttatgggtcttgcaggagtcccactgcttgtgccattgctcaaacttctgactgccctgtgcagccggtgccaggtcagcagtactctctgctctgaatcagtgtcagcactggtctctctaatgtagtacctttcttcaaaaaatgctttgtgaagctgctggttagcactgttcttacttctgtagttaatattcaccacatattccccttcttttgtggagagataaagaaattaaggaaaatcactctccataagtccacaatctgaagacatggaggctgaggaggcagacctgaatgaataagtggatcatatgatagggctagatcttaaatttggatacaggagacttaaggtaaaccacagaagcttgttgtttatacatgtagctcttttgctaaatataaatgtggcatgtgaagattaataaatctgaatgtaatgtacagaatgtactagaacaggaaaaaattggtgtttactgagagctgaaggttacatcaaaaatctaaaaagtaatatttttgcatcatcttaaagtttgcaaacagttttggcacatacatcatctcatctttgcaataacctgtggggtagatacaaaagatgatgttattttcattttccagatgaggaaataggagcctgtttcctggtcagacaggcttagtcagctgtgagtggcagagctggtgttcccacctgttaccctcaaccccagttccattgctcctaacatgattgtatcctggataaacatggtatcaagaatggagaggccaagcgcggtggctcacaccggttatcccaacactgtgggaggccgaggtgggcggatcacctgaggtcaggagttcgagaccagcctggccaacatggtgaaaccccatctctactaaaaatgcaaaaattagatgggtgtggtggtgcgtgcctgtaaacccagctactggggagactgaggcatgagaatcacttgaacctaggaggtggaggttgcagtgagccgagattgccccactgcactccatcctgcacaatagaacaagacactgtctcaaaaaaaaaaaaaaaatggagagtgaaatttgggaggctgaggcaggcagatcacttgaggtcaggagtttgagaccagcctggccatcatggcaaaagcctctctctactaaaaatacaaaaatcagcctggcgtggtggtgggcacctgtaatcccagctgctcggggctgaagcagaagaattgcttgaacctaggaggcagaggttgcagtgagccaagatcataccactacactccaacctgagcaacagagagagactctgtctcaaaaaaaaaaaaggatggagagtgagagaaaactcagagactttgaaataagaagtgaaagaggccgggcacagtggctcacacctgtaatcccagcaccttgggagaccgaggcaggcagatcatttgaggtcaggagtgcgagaccagcctggccaacatggtgaaacctgtctctactaaaaacacaaaaattagctgggcatggtggcgggcacctgtaatcccagctactcgggaggctgaggcaggagaatcacttgaaccagggaggcagaggttgtggtgagccaagatcatgccattgcacttcagcctgggtgacagagcaagactctgtctcaaaaaaattaaaaaaagaagaagaaatgaaagaaacttggcaattgattgggtgtttctgataaagaaacagaagaaggaaaaggtgattcctaggtttctaaaacctggaagaggtggacagtgagattataatataagcagctgatgttggcaacatgcctactatgtgccaggccatgtgccaagcattttgccatattgccttattaaatccttacaactctttgaaggtagatcgcataattattattctcattttagaaaagggtgtgcatgaaagttgctctcacttttagaaaaagaaaaaaatcttccctccaaaacaaggctaagctcaactggattcactggcctatgctgacagtacctggggcctgggacagtggtttggtgttcttgtgtgtatggatgtattacaatgtcagacacaaagtaactaagccgtgctcctggcggttatgatgcttgcaaatccagcactgccaaactgtttagtgcctcctaggtgctttgcctgtggttagaacaagcttcactaagtggatagttttgccttggccctgcctttaaggcagtctgccatgtcatcaagagacataggtaagaatgctctcctccttagttatgatttaaaaataaaagtataacaaagtataattatcaaatgactattagtagaaatgttgcatttatatacactatttagattacaattcttaaatacaatgtctttccttcttgttacttgtaattaattagtatcagtcactgtccagtgtgagcctggcattgcccttaggttaaccagttcacatcctgaacttctgttggtgcccagggtatttgtctgaaaccctgattatttacatctccctctaactttcaaatttgtctccaatctcatctaaaactattaatacttgagaaaaggcctttccccaatttcctgcttctaatccctttatcctctttctttcttggaaaagtagaggaaaatggtttacatatcaaataaagtaaatagtatatgaaaaaaaaaaaacctctaagggctccaaactctgtggatatctacctgctggttatttattcactaagctgcacatagcaatcccctagcaaccataaacttcatgcataaaatcccaactcttctccaataccacctgtttgtaggtagtcatccttcttttaaaagacttgggagttatacaaggaataagtgccagagtttagttctttgtgaaaataaatttaaagaaattataagttttcacagggctgtaaagatgtttcttcccagtggtccttcactccaaggctgcactggagattatgctggtgaggaagctttggtctcgtaggtctttggccccaaggcaaaaggtcatggctgtaagtgtctttcttcctgatcccctctaggattgtgaagatgtccagtcccaatctgaacattgtgaccttactgggcagttgtctcacttacagtagcgcttacctctttgggattcaggatgttttagtggggagctcaatggaaactctcattcaggtaggtgaagttttaaaatttggttttgactataaagttttgattatttttttaaaccagctgctcccgtgggtggtggtttcctttatccttggagtgggcacttttcgagggaatcccagaacacttggtgaggttcactctgtacctcgtgcgctctgtgggacccagaccctacagatcagagtgtgtggagaactgataaaggttcctcttgtgactcttctgtccccttccacccatagacaagactgtccatgctgtgcattgggacctcccttgtgtttggccccattctgggaaagagctggcgactctacaaggtgtttacccaaagggtcccggacaagagagtggtgagtaggcagcaagtacacaatgcttgactgtagatggtagcttcagcattggttaacagctagagaagctcatgcacattactgagcctagcccctttcaggacatccaaagttcctgtttctcattccaaaccctggaatcatgcagcctcataaggcctcaggtctggaaggctgtggatcagtgctgttgaagatagggcttcaaacgtgggctctggttcctatgtaccccaggccctgtggggacatgtgagctggccaatacctggcaccagtgtgaggcagaacaagatacccagagactgttgtttggcacaggtgcgagctggaagtgaagggaggaagagtgattacagagaaactatagcaagtaagtagttatttccttccctggagtccagttcttttctatgtagaaggcagttctctgtactgagaaggatgtgcccaaagcagtgagcaaggaagagcagatagaatcaactctaagttatgtagcagccagatcaccgacatgtccctggtatcagtcatcaacttaaccacatttccccattttatcaggttgtctgatgagactgctcaaacctcaattcctgaccattatcctcattgggtataggccctgcccagacccaatatatcattcagttggtgtttacttctctggaatgatgggaatttattttagcaaatgttattgaatcatggtgcatacttaccaaaagctcagctgtgagcaaccatacctatgaagaagattgcctaaaaggacaaaaactgcattcatccctcaagaacaccaatttcttttttaaacagctttactgaagtataactgacatgcagtgaactgcacatatttaaagcatatgatttgataaattgtgacatggatatacaaccaagaaacatggtgcataatgaacatatccctcatcttcaaaagcttccttgcaaccctttgttatctccctcccctgtccaatccttatatcccttgttcctatcctcagaaaatcattgatttgctgtcactgtagatgagtttgcattttccagagttttacataaatggaaccatgcagtatggactctgttttctctggcttattttactcacataattgtttttatgaatattatagttatttatctatgttgtgtgcatcaatagttatttctttgttattgctgagtagtattacaatgcatagacacaatttgcttatctgtagatggatgtttgggttatcgccagttgtggcgattaaaattaaagctgctatgaacattcgtgtacaaagtctttgtttagacataggcttttatttctcttgggtgaaaacctaagagtatggttggatcatatggtaagtgtatatttaactttttaagtaacagtcagactgtttttcgaagtggttgtaccattctgcatttccaccagcaatgtatgagagtccatttcctccacattcttggcaacatttgatttgatcagtctttttcattttaggcattctaataggtatgtgtggtagtatctcattatgctttcaaatttgcatttctctaatgcagtattgagcatttcttcacttgcttatttgccatccatacaccttctttggcaaactttctgttcaaatcttccacccattttttttttttttctgagacagagtttcattctttcgcccaggccggagtgcagtggtgtgatcttggctcactgcaacctctgccttctgctttccagcaattctcctgcctcagcctcccaagtagctgggattacaggcacccaccagcacacccggctaatttttgtatttttagtagagatggggtttcatcatgttgaccaggctggtctcgaactcctgacctcgtgatccgcctaccttggcctcccaaagtgctgggattataggcatgagccaccacacccagcctcactcatttttaaattggattttttgttgtcttattattgagttttgtgagttctttttatattctggatacaaaccctttatcagatgtatgatttgcaaagattttcttccagtttgttcttttgttccttttactttcatttacttcagaatgtctttcaaagataagacatttctcattctgatgaagttgaatttaccaatgtgttctttgtttttaggtttcttgtttatttgtttgtttgtttttgtatttttagtagagacggggctttaccatgttggccaggctggtctcaaactcctggcctcaagtgattcaccagcctcagcctcccaaagttccaggattacaggcatgagccaccacacccggccccaatgtgttcttttatggatcatgtttttggtattatatttaagaaatttttgcctaacttaaggccccaaaaggttttctcatgtgtttacttccagaaattttagagttttagctttgacatttaggcctatgatcggtatatggtatgatgtattgattgaattttagttttttacatatagacatttgattattccaacatcatttgttgaaaagattgtcctttcttcactgaattacctttgtgcctttgttaaatcagttgtccataagtgtgtagatctatttctggaccctccattctgtctcactgatgtgtctatctcaacagcaatgccatattaccctgattactgtagctttatactaaatcttgaaatcaggtagtattagttctttgactttcttcttctctttcaatgctgttttggctaatctgggtcctttgaatgcccatgtgaatttttgaatcagttcactgatttctacaaaaattcttttgggattatgttgaatctaatagatcaaattatggagaattggcttcttactaatgttgtgtcctttgacccatgaacccatttatttaggtctttaatttttcccatcatttttttgtacttttcaatattgctctttcacatctttcatcaaacttatttctagggattttatatttttatgctattttatatgttactatttttttaaatttcactttccagttgtttgttgctaataaatagaaatataattattattattatttttttttgagatggagtctcactctgtcgcttaggctggagtgcagtggtgcgatctcggcttaccgcaacctccgcctcccgggttcaagcaattctcctacctcagcctcccaagtagctaggattacaggtgcctgctaccacacctggttagtttttgtatttttagtagagatgaggttttaccgttttggccaggttggtctcaaactcccaacctcagatgatctgccttccttggcctcccgaagttctgggattacaggcattagccaccatgcctggccacagaaatataattaatttttatatgcttagcttgtatactgcaaccttgctaaactacatgttagttctagcagcttttttatagagtctatcagattttctacaaagatgatcatatcagcagtgaataaagataatttatttccaatctcttgtctgattgcactggctagatacaatagtacaatctgaatagaagtggtgagagcagatatatttgttattcttgatcctatggggaaaacagtcaaaactaagaatgatattagcagtagttttattgtaaattccatttatccagttggggcagtactattctattcttattttgctgagagttttaatcaagaactgatgttgggttttgtcaaaagctttttctgggtctattgagatgatcatacagtttttcttttcttagtttattcgcatggtggattatgttaaatggttttttttttaaacccttacacaatagactttattttttagagtagttttaagttaacataaaaattgagcagaaggtacagaggttttacatatacagtctttccccacacatgcatagcctctcccattatcaatattccccatcagagtatatacttattacaattgatggaactacattaatacgtcattatcacccagagtctgtacttgacattagggttcacttttggtgttgtacattttatgggtctggacaaatgtgcaatgacatgtatctaccattacagtatcatacagagtagttttactgccctaaaaatcctctatgcttctgctcattatctctttctctccccatatgttaaatgatttagggtgtcaaaccaaccttccatccctgggattagcttcatttggtcatgctacattatcctcttcatatattgttggactcagttttataaaaactttgtttagaatttgtacattcatgtttttaatacatattgctctgtggttgccttgtaatatatttttctagttttggtatcagggtaatgttggctttataaaatgagttgggaactattcccttcttttcaatttcaggaataatttctatagaatagcataattggcactcatgtataagtaccttacaatagtatgcttccttttatccccattcctatctttgctgttacatgttataggccccatgcaattcttttgtttaataaatcaattatctttaaaaatattttatttttttatttttaagacccaggacaacatgctgaattttgttattttctttaatgatatttaaataatgaaaactaatcatgtatttttctgtttagttaccatttccagtgttcttaatttcctgtatagatccacatttttatctcatattattttcctttgcctgaaggatatctaacattccagtgtgggtgtgctactactgaattctttcagcttttgattatctgaaaaagtctttattttgccttcatttctgaaagatatattactgagtatagaattctagactgaaattttcttttcttcttctagtactttcaagatgttcctgcactgtcttctcacttggccttgtatctgatgagaagtgtcaggtttattttatgtctacacaaaatgtgtctttcttcactgcttgctttgagtagtttccctttatcactggttttgaacagtttgattaggcaattggtttgtttttaattttacaaacaccttgaatcacgtaactggttgtgcttcttttcactggttgtcaaaagctcagatccacatttcttctgctccaattagtaaatgctattatatatacactcttcatctgagccttcatcataattccctttattttctctcttcccggttgttaaatattttaatcctatcacagtatatatttttctcaattttatttttgtagtcacaaactaacacattctcttcatcctaagtcaaatacggatggtccctgacataaaacagttcaacttacagtttttctattttacaatggtgtgaaagcaatccacattcagtagaaaccatacttaaaatacccatacaaccactctgtttttcactttcagcacagtagtcaatacattttatgagatattcaacacttcattataaattaaattaagctttgttttagatgattttgcccaggtgtaggctaatataagtgttctgagcacattaaaggtaggctaggttaagctgcaatgtttggtagcctaggtgtattaaatgcatttttgacttatgatattttcaacttatgatgggtttatccggacataaccccatcataagtcaagatcataagtcaatctgtaattcatatgtatataatgaaaatgctaatgattcttcctgcatctctgagtcccaccctctcagttaatagttattaacattgtggtgtgacattcatatctatgtgcttatataaacatatagaaataatagtttatttattttataaaacaccttgagtcctttgtgggaaaaggtaggatatgaagaagttaaacaaatggaaatgtgtaatgctaataatgatatcagcatagaagtcattgtaaatgtttggtgtctgtttcatttttgatagctacatttgaagctccttgggagggctgaccttggagcatatagctgagagcacatgggatactctagcccctctgtcatttagccagtcaacaaggagaagttttgaccttgactcttttgcagattatcaaagacctgcagttgctggggttggtggcagccctgttgatggctgatgtgatcctgctcatgacgtgggtgctgactgatcccatccagtgcctccagattctcagtgtgaggggccaaatccctagagaatctcatccccaaactggactgacctctgtggatacacaggagtcatccttgcaacaagaagataaaggactccaagaggagggagagtcaggagttgtggcttccatgtaattcttgccctagtctgctgccactcccactgctcctcctgcccgagtgtctctttgtgggcatacaatgagatatcagcatgctggaatctgcctggcagttctgccacttccacattatcaataattaaaactttcagctatcggcagttaccttcccctaattgtagaggtggaggtagtagtttaaggtggcctttggagtcagtcaaccctggttcaaatcccagctctaccaagctcaccagttgtgtgaccttgggaaagttatgtaacctctctaagtctgtttcctaattggtaaaattgagataataatactacctatctcatagggttgtggcaaagattaaatgaaacaatgtaggtaaaagacttaaccatgtccagtacatactattcaattaacaagaagtatggccgggcacggtggctcacgcctgtaatcccagcattttgggaggctgaggcaggtagctcacttgaggtgaggagtttgagaccagcctggccaacatgatgaaaccatgtctctaccaaaaatacaaaaattagccaggcgtggtggcacatgcctgtaatcccagctacttgggaagctgaggcaggagaatctcttgaacccaggaagcagaggttgcagtgagctgagattgcaccactgcactccagcctgggtgacagagtgagaccctgccaaaaaaaaaaaaaaattattatatatctccagcctcacgaggggctgaggaatacagtggaatcatggaatcgtgacactgcaagattaatgtttaaggattcaatgatttgcaaaaagcaggtgcataatgaaatagtttatagttttgttgaggcactaatttgattggggtagcaaagcacataaatgaggggtaagccctagtgtcaccaagcacacagctgttagcccaactttatcatctcttctcctaacacgtagtcactctcatttaggttctagtggagtcacctaaatgctgcagtttttacatactgagggggtatcatgtactctagaagaattcatgctccagcatgttcacaaagatctgctttgtgttcctggtaattgtgggcacctccagttctgactctgtgtcccttctaggtgacagggaaagacgtgtcctgcacttcgaccagcacccacttctgtgcttcccggtattccgatgtttggattgctctcatttggggatgcaaggttggtaaccacatctgatatggtctctgtcaccaagaaaatggatatgaagagggaattacaggaattaacgaggtgatgtctgcaaagaatcttgaactcagaggagacctctgttgatgcataaacttcaaagccatgactgtttttacttttctatttgtatttgtttgggggagaccctccaactctttagactccctcattcagtcctcccccaaatcatctggaattcacccactgtttctcctatttattggtctggtttcttaattgatttgacaataccagttttcccttcatcttccctgcaagaggaattatgaggagaaatttgacccagctttatttgttctcctaagtgcccttattatgtctcttgtgttttcttcaagatttgggcgaaggtgtcctggtgcctttcacccacctgactttctccctctggttggaagcaagactggctctgagacagatggcagcattcacagggccctttgaggggttccacctgtctcacagtgtctcccatactgccccaaatctctcaccattagactcatttgtctctgttagatgggcaaaagtagaatattatttccagaaggtagaggatacctgcatggagcactgaggatggtcctcagaacaggacagctggttttcagcttagggagacagagaactggtgctgaggggtacagggcagtcctgattccataaacaagcaagtcctgcctgacagcagactacctgttgactatcagggcagagagttctggttgactgattactggcagaggaaaaggaggagtttttgtagaaataagtaccctttaagggtaaactctggccgggcacagtggctcacacctgtaatcccagcactttgggaggctgaggtgggtggatcacttaaggtcaggagttcgagaccagcctggccaaacatggtgaaactctgcctctactaaaaatatagaaattagctgggtgtggtggtatgcacctataatcccagctacttgggaggcttgaggcaggagaatcacttgaacctgggaggcagaggttacagtgagccaagattgcgccactgcactccatcctgggcaacagagcgagactctatctcaataaaaaaaaaaagggggggtaaactttacccacttcaccactaagaaagtattagaagttgttgcttgtgaggaacaggtttaggggtaggccagactagggcagggaaacattcctttttaactatgtgcaaatattactttgacagaaatattttttaaaagaagactctaggaagtgaacagctcttgatctccagaatcttgctaatggttaaaaaaggagctttagttgtgacagatcagggtttgaatctgactccgcccctggctagccaaccctgagcctcatttaacctctctgagcctcagtttccaaattttaaaatgcggatgatgataatatcccctcagaactgttctgtctctaaagagttaatgcatgttaagagttttcagccgctcctggtccatagcaagagctcaataaatgttagatattattattactattcttccactgccccctagacacttctggaaaatacattgcctctgttggttccttgagtccctgtagaagagtgtgtcctccctagcccagaaagccagcacttcccccatagctacttactttgtgactcaatttgatttattttctccattgccttttatatactctcatttccattctattttactgtaatatctttctgtaggaaaaagaaggaaaaggatggagcatcaggaaacttactgagccagaccccatagactccctggtcagtgagaagctcctcaggaggaccccaatctccacattgagtcctaggacccctgctctctgtcaactgccccctaccccacacttctcagcagttaaggccagtgatatgcaaggatcaaatatgactcactcagacaccagccaggaatgtatagacacttgattcacacccatttcccctttaacaagaattttaatggaattaaaaacttttagtggaatcatatctgaacatttcaaaatcacagaattaatttcatttgccttttattaaattagcaatgatccaactctgctgaataccacctgatggcgtcagttacccaaaagttgggcttccctggtctcctgacttatgtgtcctctagtcattgaagatctcagggtggccacatttggccttcaggccccatttgggacactgggcattaggggaacctggaaggtatctcttccatgctgactccttcccttctggcacagccagttctccaaaatatgttctttagtgtcacccatgaaggtggagttgaccacgtcatatgatttgagggtcaccagcaggtgtcctgctgatacctgactttattttcattattagttctccctctgaatcccacagtcccacccccacctcgtctcccatggcatcttcacgttctgagtcatcaacatgaacatttttaggctgggcgcagtggctcatgccggtaatcccagcactttgggaggctaaggcggttggatcacctgaggtcaggagtttgagaccagcctgaccaacatggtgaaaccccatctctactaaaaatacaaaattagctcagcatggtggcacaagcctgtaatcccagctactcgggggctgagacaggagaatcgcttgaacccgggagacggaggttgcagtgagcagagatcatgccattgcacttcagcctgggcaacaagagcgaaactccatctcaaaaaaaaaaaaaaagaagatttttgtgcttaccttaaatctacctaccagaccaagtgttaaaagccaggaccatgacttctttgtgtcactattttctgccctacacgtactatggcactgcacacatagtcagaaaggtgaacctaattgaatctatgtgttatgtattattgactaaagctttgatttctgtatgaatgcagctcctgtggagggggcagcactttaaggtgctatgagttattttctccttagtacaaatgacaactctgagagcaggtttatattcataggaaagagaacagaatagggccctgggttccttgtaggggagcaagaaatgtcacaaaaagggtgagaactatagatggagctttcgctgtctgtgcctgccccacagtcttgcctgggtcccagcctgcctttgttctcccctttttttacccttcatctcccataaacactcactggcatggagccgctgctagcctgtagagatcctttgtgtaaattttttgaaggcccatcccttctagtcagatgcagtcttgcaggtgcaaggcttggcaagcagatggtgcctttgggcaaattagagaaaagagccccttcctatgggcactaccctggctgtggcacatgacttgacaagcagatcagaggtcactttcagcttccctgtgcaccctcagctttgagcagggcaacaccagacaatggctgtggtagcactcactatcagaggttctgtgggcccactgtcctccaagtgcccaacagctctttctgtagggatactaacccacccacatgatcctgtcctatgccttgtctcagaagagtcttatttaatggctgacttgctgacttctgataaactaattctcagcaaaggagaggaaaataacatttattaagtatctagtaggtataaggggctgccctgagggttttcttatgtgatatcttagtaaatcctcatagcagtccttaaggtaggtattattatcctaattttacagatgaggaaattggttgcaaacctactgctcattgacctcttgttccacttctctgagcctccgtcacctcttcaccccccagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccaggtatggattttgcagggctggtcctcttagtcactctagagtttttcactgacaaattgctcattttgttttctactgatacctttccatgccacttattggagagtcagaaagcagacaggggatcctagtgagctggttgcctttgtcctttctcactgtcctggtcagcaagggggacaaggcagagtggtccaagcagtggtggcagcccctgtttgcactcttccacacctgtggtgcctgtcccttgggggggctgcctcgcagtcctgcttttccatccaccctctggtctgctgcactcgttccccatcctcccctcatttccatcatgttattactatttctttcactagcctgggagcaaggaacctttatatttttccaattggggattgcagactcacaggaaaaaatccatttagatggaactttatgatttaaagtgctttctctttctttttattggaggaaaatacagaacatttctctgctttttacaataaggagaggtagaaactaaataaaaatatgtttcatattatggggattttaaaaaatcaaatgagggaggaagacagaagcagaaatagccagatagcaaagaagaaaggtagtcagagggaacagagaaggaatcctaggctcagaaagcaaggggatgtgggattgttcatgctacaccctggggaccatcaagccacatatatctaggttaatgaacttggcactaggtactttcttgtttccctcctagttctccttttcttccctctgagacctccctcatcccactcctccttcaagaccctgtcctgattcccattgcaacttccagttgactgtaaactaattcctcatgatggagctaactgataatgtaagtgttggctgatggcacgttacagtgtatttgtgaaagggaagagtgcactttgggtcatgatggtatgacatgggcatagccctgttacgattcttctctatcacaaatcctcattacagtactcaacagaatacataaatatggaaaaatctgcagcagcagcactagaaacgatggatggctattgcctctgtgccagaaactggaggaatttttgccaaatcttaatgccgtaaaaactggaatgaaggaagccatttagagctgaggcttgtttgtctgggatgaggcagaaatgggctctgagaagcaaggactgtttctccctgggagaccgggggcgggggcggggtgggtgggcaggggtaagggtaggcaggtgccttttgggaagcccaccccttaggccctgcagccaatattgttggattggtagcgatcaacaatgcagagaactggtgctgaagggtacaaggcagtcctgattccataaacaagcaagccctgcctgacagcagcctacctgttgactgtcagggcggagaggcctggttgactgattactggcagaggaaaaggaggagtttttgtagaaataagtaccctttaagggtaaactctggccaggcacagtggctcacacctgtaatcccagcacttggtgaggctgaggtaggcgtatcacttgaggttaggagttcgagaccagcctggccaacatggtgaaactctgtctctactaaaaatatgaaaattagctgggcatggtggtgcacgcctataatcccagctactcgggaggctgaggcaggaaaatcacttgaacccgggaggcagaggttgcagtgagccgagattgcgccactgccctccagcctgggcaacagagctgctaacccctttcttccttgcttgcctgcactatagagacagcaacagctagactcttcttttgccagcttcccatagagataggagtgcctatatgacaccattttgaacactagaggttttctgagaagcttctgagaaagcttttgctttcctgaaaaaggttataagcatggctaacatcaccctttttaccttcttcctgccttgaatgtatgtgattcctagagctatggcagctctcttgtgaacataaggaaaagactaagagaatatagttataatactaggaagatacagctctttccatgtaagattataaattctggaggaaatgatctatgaagggaatctgcagttcacaagaagaggactacaaatgtctaaagatttagagaagctgccttcctctggagtagaagtgtttagaagataccggacttgtcaatagaattcaaaggatattgtctcttctcaactaaagcaaactatcatgaaaaaaagctaatcttaataaaatattgaataaggattaaaaatatggtattaaatttaaaatcccaatagaagcattgactgggcaattagacactacaaaatattgaattagtgaattactttaaggaaacagaaaataaggaaacaaatgagagactagataagaaaatatggaaaatggccagatgcagtacctcatgcctgtaatcccagcattttgggaggccgatgtgagcggatcacctgaggtcaggagttcgaaaccagcctgaccaacatggtgaaaccccatctctactaaaaatacaaaaattagctgggcgttgtggcatccatctgtaatcccagctactagggagactgaggcaggagaatcgcctgaacccaggaggcagaggttgcagtgagccaagatcacgccattgcactccagcctgggcaacaagagcgaaaatctgtctcaaaaaataaaataaaaagaaaaaaataaaatatggaaaacatctaggaatacaattgagagctgataggagtctctgaaagagaacaaaataatttggggcagaagtcattatcaaagagctatcagaggaaaatgtttctgaacaaacaaagccttggtcagaaaactgaatgaattggcaatctccatgatggcgccctgcttactgctcctctctccatcctcacctctcaccactgcccccttgcatcgtaagcctcagccacatcacttcccctttgcctggtgtttgagtcctcagcagctaggacaattgtgacatctgggtactctacacacaaaaatgcagaatgaagtgctgcttgaaatctgccttccaggttttcactaagcaacaaacacttgatttgttgaattgggaatggaaatggaatgattatgaggtacaggaattgggtggatggactgcactggccttgctttccttctatctcactccctctttccctcctagctttcttaagcttcctttctcttactctgtctttcctcttccattttctcccttgtgttttttttttttctcctctggaactaactgaccatgatgtgaaactaaaaaatatattttgtagtctgttgtattttaggtttagatggtaagtagttctttttcaaaatataaaagaaactgaggtttgttaggtttctgtgtgtttccctctggctccgaggtctttggtagaagaacgattctccctgtgatacttgcactgtgtattcctagaagataatttgggaaagtaatttgagtaaatttgggaaagtgggtgaggggaactatctgggtaagggttgggggttgcagcaaaacggggttccttcttgccagtgagctttcagacatgactgtgatgggaggagtttgtgaaagcaaaggcacagatacccccagggcagcgaggcagcgccagagagcgggtgaaatggatgacattactaaggagacaaggggcccaagaagccttctttacacaggcactcaggaaatgcctgagtgtttatgccaagcactgaggtcatcactagaagtcagccagccgctgctgttctgacctgaatatgacccatcccccagccctctgctccctcagagaggcaggcaggtcctaaggtaggacattgttttctctctcctctaaccccgaaagcatttcatctgctcctccctgaagatgtgcaggcctttctaatctgccttataattatatgtatatgtcccagcacccctactagaccagtgagcattttaaagaaagcttccttcatttgttcatgcatgcatccatccatccacttattaactgctgggtacatgcacttaaacacagagtccgcctctaggtctagtggggagcaaacatgaaaggaattatcatacatgtgttaagagctttgagaaaggccttccccagcccatctgagaactcagtggcaccttctcagaaaatgaggctgggcatggtggctcatgcttataatcccagcacttttcaaggctgaggcgggtagatcgcttgagcccaagagttcgagagcaacctggtcaacatggtgaaacctggtctctgcaaaaaatgcaaaaattggctagacgtggtggctcacgcctgtaattccagcagtttgggaggacaaggcgggcagatcacgtgaagtcaggagtttgagaccagcctggccaacatggtaaaaccccgtctctactaaaaatacaaaaaattagctgggtgtggtggcgggcgcctgtaatccagctacttgggaggctgaggcaggagagttgcttaaaccgggagacaagggttgcagtgagccgagattgtgccattgcactccagccagagacagagtgagactgtctcaaaaaatataaagcaaaaattagccaggcatggtggtgcatgcctctggtcccagctacccaggaggctgaagtaggaggatcacctgagcccaggaggttgaggctgcagtgagctgtgattgtgccactgcactccagacagagtaagaccctgtctcaaaaaaaaaaaaaaagaaggaaggaagggagagagggagggagggaaggagggaggtaggaaggaaggaaggaaggaagatgaggtgttcgagctcagtcttgaaggaaacataagagttcattgaagagatgggggaaagtaggtggcatttctgatggaataacatcatgaccagaggcagggaggctagaaagagagtagcgtatgtttggagcaccatggtctttgttatttttgaagcacaaatggaaaccagggggagaatgacaggactggggagagacacacctggggagcttctgaggccctgctggaccctgttaaagagttgacatttagtcccaccatattagtttcccactgctgctataacaaattcccacaagcttagtggcttaaaataatacaagtttattatcttaaaattttggaggtcagaaatctgaaataggtcttatttggctaaacttaaggtgtcaggaagtctgtattccctccagagatgcaaggggagaatctgtttccttgtctttttcagcttctagaggccgtctgcattcttgtgcttattgtcccctcctccaccttctaagccagccaggttcaaatctgccagaagagattcaaatctttctctctctcgcccctgtttccattgtcacatctccttctccaactctggctctcctccctccctcctataaggattcttgtgattacattgggcccacttggataacccagaataatcacccctcttgaaatccttaattacatttgcaaagtcccttttgccacataaggtcacatattcacaggctccaggaattaggatgagagagaacatctttgagaagccactgttcagtctgccacacccccatagcccagaggctcagaaaaccagaatctgcctgtccttctggaggaaggcagaggagaggccctgaattgtgaaattcatagctggattccagaaaccctgaagggttgagccttaaggagtatcttcacaaatgaggaatgaagggctagagtaatcaaggggtatcttggctccacttggccaatttagagacaggaagaccaaaagccctgggagggcccttacgccagtgctgagctgctcctctgccagccctgcagagaggcctcagtctgggagtgctgggggagatgaaggaaaagctgtactgcagcactgccagggtcagtgtgaggagaataaccctaggaggtctgattcatccacccaaggccacagatgaccttgtgttgttggctccagtagctcccaagtaggatggtgagctgagagcatcctttcgtggggagggggccttcaagaagggcatctgagaggggaggtaccaggcctgacccaacacaggtcacacagactcctggtgcgatgatggactcatgatgagtcagcagaggacccaagaggacttgggtgataatatcaatttcagtggcattgaaattgatggcaggattcagaatcctatctgagatttacaaaatttggtttacactccatggtcggagcttaacaaatgtttgatggatgagtaaagaaatcccaggatccctttgaggctacccatagacactgcagcatcatttctagaatcaaggtcccagggtccccagtgtccatcactaggacacttagttatggggattcctgagaggaaaacagaggccttccccactgtggcttcctgcgtcactcacattactgtcattcggtgggtcagcagtaccccacagactcaggcagaggctcctgtttctatgttcagcttcattcctgttaaactaaaccagcccatgcttctgcagagtgttcctcaagaccagtttctcctgaagagctttccctggactgccaccgttaacagtctctctcttcatcaactgagtgaggacacagacatggcacagtgtcctgcttacagctgttgttctgctgctaagtggctgtgtaagcttagacacaacactcctgagcctttcctagtttgtcaaagaaactgggtgatgagctagagcatcctgatgtgactagggggcttccctcaaaggctctctgagccttgattattgacttgggttagaagttcacccaaaggaactgaattttcaatagcagcaagcacattgttactgaacaaatgaaaaataattaaatagctgcatgcaacgagaaagtgtcatttgaaacttatagtgttcaggttgcttaaccccaggatagctcctaactctggctttagaatgtggtggtagaagatacttcagctctggttttctttgaccagtttggcaatgggtaggcagatgggctaaggctgttctattttatctacctgtcctattcttcctttggaaatttgtgtttgtttttagggtgttttgggtttttgttttttttttttaagattgggtctcactctgccacccaggctagagtacagtatcacaacaatagctcacagtagcctgaaactcttgagctcaagtgatcctcccacttcagcctcctgagtagctgggattataggagtgagccattgcacccagccctttggcattttaaaaattatataaccttaacattttgtataattacaaaaggtaaggaccttttgtcattaccatctttgagccctccagagcaaagtacattttaaggagagaatagcttgcgcatgtgtgtatctatgatagtgtcattccttggtgtttatgagaaagagtgagagagtgtgtttctggatgtgtaattaaataaataacatgtgttcttttatctaacagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaagtaagctctgcccctgcctggaagattccctgtaaaggatccaatcatgcatcggtggcccccaaggctcttattgctgatgttctcttttcctctcattctcccacttctcttaacagcaagcaaaacctcaccatttccaccgtgacacgcatctacttcattcattcagtggacagatgtataatgagtcactcctatgtgccaggcattgtgccagtgaacaatgaacaaaagcatggttcctaccctcacagagctcacagtctagtggaagaaatagagattcattcatcaagcaaacatgtaattatacattgtcataagaattatgaaagaaaaatcagagtggtaagacagaataatgtgtggtaagggcaagaaaacataacttagaccagtcagaaaagactcattgagctgagggctgaaggttaagtacaaattagccaggcaaagagtacagggaaaagtattccaagctgcgggaacagcattgtaaaggccctgaaatgtggtggacactagcttccctgtgatacattttctctcttttttttttttttttttttttttgagatgaggcctcactctgtttcccaggctggagtgcactggtaccatcttggctcactgaaacctccacctcctaggttcaagcaattctcctgcctcagcctcccaagtagctgggactacaggcacccaccaccatgctcagctaacttttgtatttttagtagagacggggtttcaccatgttacccaggttagtctcaaactcctgacctcaagtgatctacctgccctggcctcccagggtgctgggatcacaggtgtgagccgccgcgcctggcctcattttctctttttacatagagtagtgtcttcatgtccaagatctcctggggtccttactgtctttcccaggtactggctacagatctcaatcagcccatcatcccagaaagtccaggcatgtctacagatggagaaggggactaaacaagggcttctgaatgtgattgtagcaccaagggagaatgaggcagctcccccgggcttctttcttctgtatttgagccagagttggcccctctcccagacttgggcagtgtgatgcaggcatgaagaaagcacgtggaaaggtttgaaggcttcgttgactcaggaagaaggcacagggcccaggggagttagtcagtattttgacactaactgaattacattccatattttttcagtttagaacctatctcaggaggtgttatttggaaaactgggctttttttttaggactgctgcctaggtattaatagtccctgatgagaggatagtgtggtggggacctagaaaacacaacagatgaagggactcagcacacccaggcacccaccgttcatgcccctctatggttctggaccatttttgtccatcagagtaacacctctccatttctttactattaagtatttcaaagccagatttctttccacctggcaagggagtaatattgcctttgatactctgtgaagtcttcaaataagcatttttttttcctggctacacagaaggccagaaacttggctagaacagccaggatagttttcattcacagtcagctgatgctggaacagccaagtggactgactctttagccttatggtaatttgcaacgtgctgtttgtacttctgccatgctaccctgtttcccacgcagggactcaatctgctatatccaaaaagatgctttgagtctgcagaggaagcccttcaatgggcacaggtgcacaagtggtaagaagctggcctccccagtgcacgctacacctggaatctctttcccagaacaggccagagaacaagcggccagtcctagggcccggtggcaggtgtcaggaggttccagcatctgcatccccagctccagcattgcccgttagagaaacatgagtatctctcctggctcaacatatgtacagaccttgactctggcccatggtgtgcagtgccttcctgtgcaggccccactcccccactcaggccttcctcttactttcccgtgatctgggcagccccatcttctcacacttttccctcttgcctctatagccaggggtccccccagaagctgtttcggacagcatctatcacatctatcactgacttccctgtctaagagaaggccagcagacagaaccttccacaaggctgaagtgctttcctcatacactctgcagccaagtaaacaaacctattacttttgttacctgaaccatagaaacaagaggctaattccatgtctccttatggcctgccccctgtgaaacatgcaggtggatgttttgcttccctcaatatgccaaaaataataattaataagctcattgaagtgcagctgccgtggtaggtcagatttcagtctcataatggcagtgcctcacaccacacctctaattagtatgcagccatggtaaaaacagagtcccacttctttttctggaagaaggaaattttctgtttaggttgatgtttctaaatctgtcaccagccagcttcttcccaactccatgtttatagtatctttctatactcaaaggagtttatagataaggcacaaaaagacagcactcagatttcacccacgggagtagttgccatctgccgatgggtccttcctaactctgtgaggctatagaggcctccagaagcccacatgagaatgtgcacgatgggcttcaggaggagaggctggtggaggagggagttgaggtccccccatgagatcctcagagagatgcctggcacagcccaggatcacaaacacctgagtgtttccctattgctcatccattctgcccctgacaagtccttgagtcatctgcactcacccagcaacacccagacctcaccactctgcgggcagagggaagggagggaggacaggcacacatgtgctcagctgaaagtctcttctaccttactcaccagtccctcactggccctggactctcttctgatggtaaaagaagtatactcaaccagggtgaaactagcaataccaactatcagaaaaatcaccttcccaattctacaaggggagcagtgcatctgcttggagagttgctagtcagaatattggactattttgcttaagctactgctcccttaaaggatcatttctaggcaactctcccatgtaaacctgagatgaaaccacaggttcactctataactagtagtcctagttagctgttatggacggtataactaggcaatttgtattggttatcctaacacagggaacatccttttgtttctagggcataataaatggaggtccaaatgctcatgcccagctcctaaagatgatagtaacaaagaggtagcattttggtgttcagacaagcactttctagaacatttgcttacattattgccttcccagaaccctcgaccccatgtcatctgccccaagtccagacgttccctgtgaatatctcctccctgctctgcctttgaggatcagaagtttccagagatggacacacagtctgaactagagaatcagctgctgcaccacagaaagatgtctgggctgcagtcgttccctgcaacccactgccaacactcctactcctacttcatgccccacaatctcgcagttaggacaggcacacctctgcagctctcacctgccagccctctccggcacaacttgtttaccagctaacatccagcgagtaggcaggtcagtagcagaactgccccaggctccttcgtctcctgggctccattctagggctgctgaatcaagctagcaggggcttaagcccaacagtcctttcatttctttgtgcttcttcaatagttctgatgcttgcactcctttaggtgagtggttcccaacatttttggcaccagggaccacttccgtggaagacagtttttccacagatagtggtggggggatggtttcgggatgaaactgttccacctcagatcatcagacattagcttctcataaggagtgtgcagcctagacccctcacatgtgcagttcacaatagggtttgcgcttctgtgagaatctaatgtctcagctgatctgatggaagctcaggtggtaatgcttcctcacccaccgctcacctcctgctgtgcggcctggttcctaacagtccatggactagtactggtccgtggcccaggagttggggacccctgctttaggtgaaatcaacagctgatattgccacatggtagctttggccactcactcccagaggtccagcctagggaggtgataacaccaacctgagattctctttggcccctctcagctccaatcttatttgattgtcacagaaatctccacccttctccttgttcttcccattttctaggctgtttagtaagaggcaaaatacttgttctcctacttcttcatcccctggagatatgcttcacatttatctaaatttttgcaaaagtgtgataaactccaagtgggaccattccaaacattattcagctcatacctgcggagtggcctgaccctctcagttctgggaaaggtgagagggcgctgcagtggccagcaggcactcagactgggcctccttgctcttcataagcaatgccgcacagtgtggggatgtaaggagaagaccaagataatgacaataaatcatggttggcctttattgagcaccgtttatgtcagttattgtgctagcactttacatgcatcaactcatttcactggagggaggcacctccttagaacctgaggtcaccagccaatacactggaagaactgagatttcagccaaggttctttgaaagccacaccttctccaccatggtgggcactatggaaccctcggcggcatcttttgttgatggttttgcttttattttacagaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggancccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgttactacctcgcagccttactataaaagactccagttgagtgactatgaaagacactgactccttggataaaaggtgctgaatgaacacataggattttctgtccaggtcagcctacattctgtaaaactcttaatatattcagatggatggctgaatggacagacagatggagagatgcatgggaaatttctgtagaacttgaggtgtggactgtgacccatcaaactggccttttggtggacagacctaccaggaagataagtctcctacatccttgggcctcccactcctggaaggcagtggttttatttctgctgaatgttgtgaacagcacctccctagattccagcttctggccagacccagctcagagccacccctacaccactatttcttgatggtgtctttccaccattatggcactttaccctcctctctgagacagatctccatgcgcccgcaggcttcccagatctctcccctgggatcggatgtacctgaggtcctgactgtccccactgtccccttgtcctgtggctcatcctcgattcacccactgatgcagttttgtactgcggggaggcacacaccagcaatttctgttggggtatgggagaacctgttggtcaagagtgcttttggttccattggggttacatgactaccaacagacacataaacctggaagccaaatggagaaataaaaaggaagacacgagggacacgaaaacaggaaagaaaacaggatttgaatatttcacttgagtccagcatagtacttggcaatatcatatttttgtgattccttttgataaccctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagaccctggactcttcctgcccctgggggtcctgtggctgggctccccctcctgcagctcccttcctcccagcatgccaccactagcagcccaccattcattcatgtggactctaaatctggcaatccttctagccttctcactctgtctgcttctagaaccttagtcccaccatccccgcccttctacatctccatccttctgtttagaattttttttcccactttgtgcccttgtgaattattcatccttcaaggctcaggtggagcatacattctttcttcaacctttcccagccatccccaaagaaagctgattgattccctagttaaataaggaaggatgggctggaagcagtggctcacgtctgtaatcccagcac

SEQ ID NO: 16 - DNA, 120438 bp, Homo sapien; identical to SEQ ID NO: 15
  Mutant (E529D) GPR156 short isome genomic DNA (D512 variant)
  variation (117154) .. (117154): n is c or t
  variation (117205) .. (117205): n is c or t

SEQ ID NO: 17 - DNA, 2442 bp, Artificial Sequence
  Wild type full length GPR156 cDNA (E516 variant)
  variation (1548) .. (1548): n is a or g
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 18 - DNA, 2442 bp, Artificial Sequence; identical to SEQ ID NO: 17
  Wild type full length GPR156 cDNA (D516 variant)
  variation (1548) .. (1548): n is c or t

SEQ ID NO: 19 - DNA, 2430 bp, Artificial Sequence
  Wild type GPR156 short isoform cDNA (E512 variant)
  variation (1536) .. (1536): n is a or g
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggagcccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 20 - DNA, 2430 bp, Artificial Sequence; identical to SEQ ID NO: 19
  Wild type GPR156 short isoform cDNA (D512 variant)
  variation (1536) .. (1536): n is c or t

SEQ ID NO: 21 - DNA, 2442 bp, Artificial Sequence
  Mutant (E533D) GPR156 full length cDNA (E516 variant)
  variation (1548) .. (1548): n is a or g
  variation (1599) .. (1599): n is c or t
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtcagtatgacggtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggancccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 22 - DNA, 2442 bp, Artificial Sequence; identical to SEQ ID NO: 21
  Mutant (E533D) GPR156 full length cDNA (D516 variant)
  variation (1548) .. (1548): n is c or t
  variation (1599) .. (1599): n is c or t

SEQ ID NO: 23 - DNA, 2430 bp, Artificial Sequence
  Mutant (E529D) GPR156 short isoform cDNA (E512 variant)
  variation (1536) .. (1536): n is a or g
  variation (1587) .. (1587): n is c or t
atggagcctgaaataaactgctctgaattgtgtgacagttttcctggccaggagctggatcggagaccccttcatgatctctgcaagacaacaattacatcttcccaccacagcagtaagaccatctcttcattatctcctgtcctcttgggtattgtttggacttttctcagctgtggacttctgctgatacttttctttcttgcctttacaattcactgcaggaagaacaggattgtgaagatgtccagtcccaatctgaacattgtgaccttactgggcagttgtctcacttacagtagcgcttacctctttgggattcaggatgttttagtggggagctcaatggaaactctcattcagacaagactgtccatgctgtgcattgggacctcccttgtgtttggccccattctgggaaagagctggcgactctacaaggtgtttacccaaagggtcccggacaagagagtgattatcaaagacctgcagttgctggggttggtggcagccctgttgatggctgatgtgatcctgctcatgacgtgggtgctgactgatcccatccagtgcctccagattctcagtgtgacagggaaagacgtgtcctgcacttcgaccagcacccacttctgtgcttcccggtattccgatgtttggattgctctcatttggggatgcaagggtctgctcctgctgtatggtgcctacctggctggcctgactggccatgtcagctcccctcctgtgaatcagtccttaaccatcatggtgggggtcaacctccttgtactggctgctgggctgctttttgtagtcaccagatacttgcattcctggcccaacctggtctttggactcacatctggagggatctttgtttgtacaactacaatcaactgcttcatcttcattccccagctgaagcaatggaaggcatttgaagaggaaaaccaaacaatcagacgcatggccaaatatttcagcactcccaacaaaagcttccatacccagtatggtgaggaggagaactgccacccgaggggagagaaaagctccatggagaggctcctcacagaaaaaaatgctgtgattgaaagcctgcaggaacaagtaaacaacgccaaagagaagattgtgaggctgatgtcagctgagtgcacctatgacctcccagagggggctgccccacctgcctcttccccgaacaaggacgtccaggcggtagcctcggtccacaccctggcagctgctcaggggccttcgggtcacctctctgactttcagaatgatcctggcatggctgcccgggattcccagtgcacttcagggccctcctcatatgcacaaagccttgaggggcctgggaaggactccagcttctccccagggaaggaggagaagatatctgactcaaaagacttttctgatcatttagactcaggttgtagccagaagccatggactgagcaaagcctgggtccagaaagaggagaccaagtccccatgaaccccagccagagtctcctaccaganagaggcggctcagatccccagagacagaggcatctggagaactcagaggancccccagagcggcggtcacgggttagttcagtaatcagggagaaacttcaggaggtcttacaagatctgggcctgggccctgaggcttccctctccaccgccccctcttgtcatcagcaaacctggaagaacagtgctgccttcagcccccaaaagatgcccctctccaaggagctcggctttagcccttacatggtgaggagaaggcgggcagctcagcgggcccgctcacactttcctggctctgcaccctcatctgtggggcatcgggcaaacaggactgttcctggggcacacagcaggctacatgtgcagaatggggacagccccagcctggccccacaaactactgattccagagtacgaagaccttcttccaggaagccttcactaccttcagatcctcaagacagaccaggtaccctggagggcagcaaacaaagccagacagagcccgagggggctagagggagcaaagcagcctttcttcgccagccttctggttctggccgggccccaagtcctgctgccccatgcctctccaaagcctcacctgacttgcctgaacagtggcagctgtggcccccagtgccctcaggctgtgcctccctgtcttctcaacacagctattttgatactgagtccagcagctcagatgagttcttctgccgctgccaccggccctactgtgaaatctgcttccagagctcttctgactctagtgacagtggcacatcagacactgaccctgagcctactggggggctggcttcctgggaaaagctgtgggcccgctccaagcctattgtgaacttcaaagatgacttgaaacccacgctggtg

SEQ ID NO: 24 - DNA, 2430 bp, Artificial Sequence; identical to SEQ ID NO: 23
  Mutant (E529D) GPR156 short isoform cDNA (D512 variant)
  variation (1536) .. (1536): n is c or t
  variation (1587) .. (1587): n is c or t

SEQ ID NO: 25 - DNA, 2379 bp, Rattus norvegicus
atggagccggaaatcaactgctctgaattctgtgacagttttcctggtcaagagctggatcggagaccccttcatgatctttgcaagacaaccattaccgactcccagcatggtagtgcggacatctccccactgtctcctgccctcctgggtgttatttggacctttctcagctgtgggctacttctggtgcttttctttctggctttcacaatccgctgcaggaagaacaggattgtgaagatgtccagccccaatctgaacattgtgaccttgctgggcagttgtctgacctacagcagcgcttaccttttcgggattcaggacgctcttgtggggagttcagtggaagctctcattcagacgagactgtccttgctgtgcatcgggacgaccctggtgtttggccctattctggggaagagctggcgactctacaaagtgtttacccagagagtcccggacaagagagtgattatcaaagacctgcagttgctggggttggtggcagccctggtggtggctgatgtaatcctgctcgtgacgtgggtgctgacggatcccatccagtgcctccagatccttggtgtcagcatgaaggtgacagggagagatgtatcctgctctttgaccaacacacatttctgtgcttcacggtactctgatgtctggattgccctggttttgggatgcaaggggctgctgctgctgtatggcgcttacctggctggcctgaccaaccatgtcagctctcctccagtgaaccagtctttgaccatcatggtcggagtcaacctcctgctcctcactgctggcctgctttttgtggtcaccagatacttgcactcctggcccaatctggtctttggactcacatcyggaggtatcttcgtttgcaccaccaccgtgaactgctgtgtcttccttccccagctgaggcagcggaaggcatttgaaggagaaaaccaaacaatcagacacatggccaaatacttcagcactcccagcaaaaccttccgcagcaagttcgacgaggaccagagctgccacttgagagatgagaasagctgcatggagaggctcctcacggaaaaaaacgcagtaatcgaaagcctgcaagagcaagtgagcaatgccaaggagaagctggtgaagttgatgtctgcggagtgcgccctggactccccagagtgggccgtcccagctgcagcctctgccggtggaccygcagaatgccycgctacttctgagaaagagagcggagcagctgctgaggactccctacctgcctcagcggcctcccagcacatgcaaggccccggggcatcgagaagggacrccagtccctctccagaccaaaagtacgacatgcctttgaaacagttttgtgatcatttggacatgggctgcagccaaaagccaaaggctgaacaaagcgagggtcctgaaagaggaaaccaggaacccatggcccccggtcagagtctaatgacagatggagtggcttgtgaaccccataggcccaggcagaactcagaggtactcccggagaggctaccccgggttagttcagtggtcagagagaagcttcaggaagttctacaagagctggacctgggcaccgaggctcccctttccccactgccttgtccccagcagccctggaagagtaacacttccggcagcccccagaagctgtccccatctaaactgggtttcagcccgtatgtggtgagaaggagacgggcagcccagcgggctcgctcacgcatccctggctctgtgggcctcaagatggggcatcaagcaaataatactgtttctggttcacaaaatgggcttattgtacagaacagagacagccccaggctggaccaccacaatgcaaggtccaaggaaccaaggtcctcttctgtaaaaccatctccaatctcagcacctcaccagagacggggtagcctggagggcagcaaacagtgtgagacagagcctcaggaggccaggggatacagtgtagcttttcctcgacaaccttctgcttctgccccggcacaaagttccactgccccatgcctatcctcttyaccagcgctgcccaggcagcgtcagcctctacccctactgtcccctggctgtccttccttgtcttctgggtgctacaaccttgacagtgagtctagcagctcagatgagttcttctgccgctgccacaggccctactgtgaaatttgcttccagagctctttggactccaatgacagtgacacttcagacagtgaccttgagcagacttcaggattggcctcctgggaaaagctgttggcccgctccaagcctgttgtgaacttcaaagatgacttgaagcccacactagtgtga

SEQ ID NO: 26 - DNA, 4600 bp, Mus musculus
gcggtccgcgtccctcccgccaccttccaaacccgagagcccaccagagaccggaagagcacgcgcgtcccaatcccggccgcgggctcggcgcatctctgcggacggggaccccgcaagggcccagtgtgggagcacgtggagtgctgactgccctctggtggtgagccagaatcaattcgttctatgacctgagatgcccactcttgaccatgtgctacccactgggagccaggaaccagctgaagaacatttgctcttcaaatatgcatgatgaaggagactaatgaaacaacctttcacttctacttggagccatttgttttttaatcctggatttggactctggaggcaactctgagatggagcctctggcagaaagactcgagttgtttctgtgcttcagcgaacggtttgcatccttgactgggaatagccaagactgagtagatgcccatagaagtgcatggggtgacatggagccagaaatcaactgctctgaattttgtgacagttttcctggtcaagagctggatcggagaccccttcatgatctttgcaagacaaccattactgagtcccagcacagtagtacagccgcctccccactgtctcctgccctcttggggattatgtggacctttctcagctgtgggctacttctggtgctcttctttctggctttcacaattcgctgcaggaagaacaggattgtgaagatgtccagccccaatctgaatgttgtgaccttgctgggcagttgtctgacctacatcagcgcttacctttttgggattcaagatgctcttgaggggagttcagtagaagctctcattcagacacgactgtccttgctgtgcattgggacgtccttggtgtttggccctatcctggggaagagctggcgactctacaaagtgtttacccagagagtaccggacaagagagtgatcatcaaagacctgcagttgctgggattggtggcagcactggtggtggctgatgtaatcctgcttgtgacatgggtgctgactgaccccatccagtgcctccagatgcttggtgtcagcatgaaggtgacagggagagatgtctcctgctctttgaccaacacacacttctgtgcttcacggtactccgatgtctggatagccctggttttgggatgcaaggggctgctgctgctgtatggtgcttacctggctggcctgaccaaccatgtcagctctcctccagtgaaccagtccttaaccatcatggtcggggtcaacctcctgctcctcaccgctgggctgctttttgtggtcaccagatacctgcactcctggcccaatctggtctttggactcacatccggaggtatcttcgtttgcacaaccactgtgaactgctgtgtcttcattccccagctgaagcaatggaaggcatttgaaggagaaaaccaaacaatgagacacatggccaaatacttcagcactcccagcaaaagcttccacggccagttcgatgaggacccgagctgccacttgagagatgagaagagctgcatggagaggctcctaacagaaaaaaacgcagtaattgaaagcctgcaagagcaagtcagcaacgccaaggaaaagctggtaaagctgatgtctgccgagtgcacctatgactccccagagtgggctgtcccagatgcagcctctgcccgtgggctggcacttccgggaccttcggaatgccctgctgtttcggagaatgagagcggagcagctgctagggactccctacacgttccagcggcctgccagcacgtgcaaggccctggggcatcgagaagggacaccagtccctccccagcccaacaggacaacatgcctttaaaacagtattgtgatcatttggacacgggttgcaaccagaagccaaaggctgaacaaagcgagggtcccgaaagaggagaccaggaacccatggcccccagccagcgtttaatggcagatggagtggcctgtgaaccccataagcccaggcagagcccagagggactcccaaagaagctacctggggtcagttcagtagtcagagagaagcttcaagaagttctacaagagctggacctgggctctgaggctcccctttccccactaccctgtccccagcagctctggaagagtaccacttcccgtagcccccagaagctgtccccatctaaactgggtttcagcccgtacgtggtgaggaggagacgggcggcccagagggctcgctcccacatccctggctctgtgggtctcaatgtggggcatcaagcaaatagtaccgtttctagttcacaaagtgggcttattgtacagaacagagacagtcccaggctggaccacaacaatgcaaggtccaaggtaccaagatcttcttctgtaaaaccatcaccactctcggaacctcgccggaaacagggtaccctggagggcagcaaacaatgcgagaccgagcctcaagaggccggcggagcatgcaatgtagcttttccttgccaatcttctgcttctgtccaggcacaaagtcccgcagccccatgcctaccctcttcaccagctctgcccaggcagcgtcagcctcgaccccgactgtcccctggctgtccttccttgtcttctgggtgctacaaccttgacagtgagtccagcagctcagacgagttcttctgccgctgccacaggccctactgtgaaatctgcttccagagctctttggactccaatgacagcgacacttcagacagtgaccttgagcaggcttcaggattggcctcctggggaaagctgtgggcccgctccaagcctgttgtgaacttcaaagatgacttgaagcccacgctagtgtgaaaagcggcaaggtgggctggccacagaggtcagcaccatgctttggccagcctcaactgtgttccagctgtgctttcttactctaaaagggcgttcgttacccaccctgctactacctcagcgttactgtgagcagctctagtgagggattgtagaataactccttcaactgaaggtgctaaatgagaggtagtcttgtccattcagctcagcctactctttatgattttctgggtgtataccgagtagctagctggatcgatgaccaaaagatggagagagagatttttttgcagaaccactgtgagccaccaaactagcctttcagtgaacagacctgcaggtagatgagcctatacctttgtctctccaactcggagaaagggtgccttgctttctgctgaaggctctaagccttcactgtgtcagggtttcagcttccggttcaagtcgccccagcactctccactccacttgttgcccacataccatcctggcacctctcacaccatgacccccgacataatttcctaacgtgttcccatacgcttctcagatggtgctcctggactcagtagtgtctggagcctgccccctgctctctcccagccacacgatgttgtacttgaacacatagcagcggtagtctgtgctgggagactttctggtcaaaaggtagttttggtgctattgaggttacatgaccaccaaagatccataaacctagaaagaaaatagggaaataggaagaaatgaagggctgagtgtggttgtgcacatctttcatcccagtgctcaggagcagaggctggcagatctctctgagtttgaggccaacctggtctacatagagagttccagacaaccagggttatatagagaggtcctgtctcaataatagtgatgatgatgatgatgatacaagaaggcaaggaagaaagaaaaacaggaacagattgtgaacatttcactagagtctggctcggtacttggcaataccaaatttcagtgtctcttaatgataacccattgaagcagacactcttctctctacggctaggggccacagggcttagagaaatgaggtgacttccctaattccatactgctgcaacgtgactattggagaatttgcacatgctgctgaaactgaggttggtgggtctccccagggatacatctctttagtcattcttctggaagtggcaggcaagatctaagtgacagacaactgaatcaaggcagggcgagctggtatgatgtcccttgaggacaaaaccaagttctttaccaccacttcccactgtgggggcaacacctgcacttccaggggaactaggaacttggtaaagagtgagctccagggactccctaaactcactaaggctgcagggaagacaaattggaccacttcaactattgcttcacttgtcacctgctgcccacactgccgtactgcatctgcactgcgtgtagattttgtttggagttcagagaaggcatctgacaccaaacatctcacagatatgtcacagactctcaggtgcttagccatggaggccctgctggtaggacagcatcttctgctgtctattgttcaatacgaatgtcataatttattctgtgtgtatacattggggagtgtagcttccgtgtgtgttgtttgtatgatgaccacgagtatcttaataaaaaagaaatgactgtcaaaaaaaaaaaaaaaaaaa

SEQ ID NO: 27 - protein, 792 aa, Rattus norvegicus
  misc_feature (355)..(355): Xaa can be any naturally occurring amino acid
  misc_feature (413)..(413): Xaa can be any naturally occurring amino acid
  misc_feature (447)..(447): Xaa can be any naturally occurring amino acid
  misc_feature (695)..(695): Xaa can be any naturally occurring amino acid
MEPEINCSEFCDSFPGQELDRRPLHDLCKTTITDSQHGSADISPLSPALLGVIWTFLSCGLLLVLFFLAFTIRCRKNRIVKMSSPNLNIVTLLGSCLTYSSAYLFGIQDALVGSSVEALIQTRLSLLCIGTTLVFGPILGKSWRLYKVFTQRVPDKRVIIKDLQLLGLVAALVVADVILLVTWVLTDPIQCLQILGVSMKVTGRDVSCSLTNTHFCASRYSDVWIALVLGCKGLLLLYGAYLAGLTNHVSSPPVNQSLTIMVGVNLLLLTAGLLFVVTRYLHSWPNLVFGLTSGGIFVCTTTVNCCVFLPQLRQRKAFEGENQTIRHMAKYFSTPSKTFRSKFDEDQSCHLRDEXSCMERLLTEKNAVIESLQEQVSNAKEKLVKLMSAECALDSPEWAVPAAASAGGPAECXATSEKESGAAAEDSLPASAASQHMQGPGASRRDXSPSPDQKYDMPLKQFCDHLDMGCSQKPKAEQSEGPERGNQEPMAPGQSLMTDGVACEPHRPRQNSEVLPERLPRVSSVVREKLQEVLQELDLGTEAPLSPLPCPQQPWKSNTSGSPQKLSPSKLGFSPYVVRRRRAAQRARSRIPGSVGLKMGHQANNTVSGSQNGLIVQNRDSPRLDHHNARSKEPRSSSVKPSPISAPHQRRGSLEGSKQCETEPQEARGYSVAFPRQPSASAPAQSSTAPCLSSXPALPRQRQPLPLLSPGCPSLSSGCYNLDSESSSSDEFFCRCHRPYCEICFQSSLDSNDSDTSDSDLEQTSGLASWEKLLARSKPVVNFKDDLKPTLV

SEQ ID NO: 28 - protein, 798 aa, Mus musculus
MEPEINCSEFCDSFPGQELDRRPLHDLCKTTITESQHSSTAASPLSPALLGIMWTFLSCGLLLVLFFLAFTIRCRKNRIVKMSSPNLNVVTLLGSCLTYISAYLFGIQDALEGSSVEALIQTRLSLLCIGTSLVFGPILGKSWRLYKVFTQRVPDKRVIIKDLQLLGLVAALVVADVILLVTWVLTDPIQCLQMLGVSMKVTGRDVSCSLTNTHFCASRYSDVWIALVLGCKGLLLLYGAYLAGLTNHVSSPPVNQSLTIMVGVNLLLLTAGLLFVVTRYLHSWPNLVFGLTSGGIFVCTTTVNCCVFIPQLKQWKAFEGENQTMRHMAKYFSTPSKSFHGQFDEDPSCHLRDEKSCMERLLTEKNAVIESLQEQVSNAKEKLVKLMSAECTYDSPEWAVPDAASARGLALPGPSECPAVSENESGAAARDSLHVPAACQHVQGPGASRRDTSPSPAQQDNMPLKQYCDHLDTGCNQKPKAEQSEGPERGDQEPMAPSQRLMADGVACEPHKPRQSPEGLPKKLPGVSSVVREKLQEVLQELDLGSEAPLSPLPCPQQLWKSTTSRSPQKLSPSKLGFSPYVVRRRRAAQRARSHIPGSVGLNVGHQANSTVSSSQSGLIVQNRDSPRLDHNNARSKVPRSSSVKPSPLSEPRRKQGTLEGSKQCETEPQEAGGACNVAFPCQSSASVQAQSPAAPCLPSSPALPRQRQPRPRLSPGCPSLSSGCYNLDSESSSSDEFFCRCHRPYCEICFQSSLDSNDSDTSDSDLEQASGLASWGKLWARSKPVVNFKDDLKPTLV

What is claimed is:

1. A genetically modified rodent, whose genome comprises a humanized G protein-coupled receptor 156 gene at an endogenous rodent Gpr156 locus, wherein the humanized Gpr156 gene comprises a rodent Gpr156 nucleic acid portion and a human GPR156 nucleic acid portion, wherein the humanized Gpr156 gene encodes a mutant human GPR156 protein comprising Asp at an amino acid position corresponding to position 533 in a full length wild type human GPR156 protein (E533D variation), and wherein expression of the humanized Gpr156 gene is under control of the rodent Gpr156 promoter at the endogenous rodent Gpr156 locus.

2. The rodent of claim 1, wherein the human GPR156 nucleic acid portion comprises the ATG start codon through the stop codon of a human GPR156 gene, wherein the human GPR156 gene comprises nucleotides that encode the E533D variation.

3. The rodent of claim 2, wherein the human GPR156 nucleic acid portion further comprises the 3' UTR of the human GPR156 gene.

4. The rodent of claim 2, wherein the rodent Gpr156 nucleic acid portion comprises a 5' non-coding exonic sequence and/or a 3' non-coding exonic sequence of a rodent Gpr156 gene.

5. The rodent of claim 1, wherein the humanized Gpr156 gene is formed from a replacement of a rodent genomic fragment of an endogenous rodent Gpr156 gene at the endogenous rodent Gpr156 locus with the human GPR156 nucleic acid portion.

6. The rodent of claim 5, wherein the human GPR156 nucleic acid portion comprises the ATG start codon through the stop codon of a human GPR156 gene, wherein the human GPR156 gene comprises nucleotides that encode the E533D variation.

7. The rodent of claim 6, wherein the human GPR156 nucleic acid portion comprises a human genomic fragment comprising the ATG start codon through the last exon of the human GPR156 gene.

8. The rodent of claim 5, wherein the rodent genomic fragment of the endogenous rodent Gpr156 gene being replaced comprises the ATG start codon through the stop codon of the endogenous rodent Gpr156 gene.

9. A genetically modified rodent, whose genome comprises a humanized Gpr156 gene at an endogenous rodent Gpr156 locus,
  wherein the humanized Gpr156 gene encodes a wild type human GPR156 protein,
  wherein the humanized Gpr156 gene comprises the 5' non-coding exonic sequence of a rodent Gpr156 gene, a human GPR156 nucleic acid portion, and the 3' non-coding exonic sequence of the rodent Gpr156 gene,
  wherein the human GPR156 nucleic acid portion comprises the ATG start codon through the stop codon and the 3' UTR of a human GPR156 gene, and
  wherein expression of the humanized Gpr156 gene is under control of the rodent Gpr156 promoter at the endogenous rodent Gpr156 locus.

10. The rodent of claim 9, wherein the humanized Gpr156 gene is formed from a replacement of a rodent genomic fragment of an endogenous rodent Gpr156 gene at the endogenous rodent Gpr156 locus with the human GPR156 nucleic acid portion.

11. The rodent of claim 1, wherein the rodent is homozygous for the humanized Gpr156 gene.

12. The rodent of claim 1, wherein the rodent is incapable of expressing an endogenous rodent Gpr156 protein.

13. The rodent of claim 1, wherein the rodent is a mouse or a rat.

14. An isolated rodent cell or tissue, whose genome comprises a humanized Gpr156 gene at an endogenous rodent Gpr156 locus, wherein the humanized Gpr156 gene comprises a rodent Gpr156 nucleic acid portion and a human GPR156 nucleic acid portion, wherein the humanized Gpr156 gene encodes a mutant human GPR156 protein comprising an E533D variation, and wherein expression of the humanized Gpr156 gene is under control of the rodent Gpr156 promoter at the endogenous rodent Gpr156 locus.

15. The rodent of claim 9, wherein the rodent is homozygous for the humanized Gpr156 gene.

16. The rodent of claim 9, wherein the rodent is incapable of expressing an endogenous rodent Gpr156 protein.

17. The rodent of claim 9, wherein the rodent is a mouse or a rat.

18. An isolated rodent cell or tissue, whose genome comprises a humanized Gpr156 gene at an endogenous rodent Gpr156 locus,
wherein the humanized Gpr156 gene encodes a wild type human GPR156 protein,
wherein the humanized Gpr156 gene comprises the 5' non-coding exonic sequence of a rodent Gpr156 gene, a human GPR156 nucleic acid portion, and the 3' non-coding exonic sequence of the rodent Gpr156 gene,
wherein the human GPR156 nucleic acid portion comprises the ATG start codon through the stop codon and the 3' UTR of a human GPR156 gene, and
wherein expression of the humanized Gpr156 gene is under control of the rodent Gpr156 promoter at the endogenous rodent Gpr156.

19. The isolated rodent cell or tissue of claim 14, wherein the rodent cell or tissue is homozygous for the humanized Gpr156 gene.

20. The isolated rodent cell or tissue of claim 14, wherein the rodent cell or tissue is incapable of expressing an endogenous rodent Gpr156 protein.

21. The isolated rodent cell or tissue of claim 14, wherein the rodent cell or tissue is a mouse cell or tissue, or a rat cell or tissue.

22. The isolated rodent cell or tissue of claim 18, wherein the rodent cell or tissue is homozygous for the humanized Gpr156 gene.

23. The isolated rodent cell or tissue of claim 18, wherein the rodent cell or tissue is incapable of expressing an endogenous rodent Gpr156 protein.

24. The isolated rodent cell or tissue of claim 18, wherein the rodent cell or tissue is a mouse cell or tissue or a rat cell or tissue.

* * * * *

UNITED STATES PATENT AND TRADEMARK OFFICE
CERTIFICATE OF CORRECTION

| | |
|---|---|
| PATENT NO. | : 11,470,828 B2 |
| APPLICATION NO. | : 16/744493 |
| DATED | : October 18, 2022 |
| INVENTOR(S) | : Meghan Drummond Samuelson et al. |

It is certified that error appears in the above-identified patent and that said Letters Patent is hereby corrected as shown below:

In the Claims

Column 35, Claim 1, Line 40 should read:
prises a humanized G protein-coupled receptor 156 (Gpr 156) gene at Signed and Sealed this
Thirty-first Day of January, 2023

Katherine Kelly Vidal
*Director of the United States Patent and Trademark Office*